US009220746B2

(12) United States Patent
Clemmons et al.

(10) Patent No.: US 9,220,746 B2
(45) Date of Patent: Dec. 29, 2015

(54) COMPOUNDS AND METHODS FOR TREATING BONE DISORDERS AND CONTROLLING WEIGHT

(75) Inventors: David R. Clemmons, Chapel Hill, NC (US); Clifford J. Rosen, Freeport, ME (US)

(73) Assignees: The University of North Carolina at Chapel Hill, Chapel Hill, NC (US); Maine Medical Center, Scarborough, ME (US)

( * ) Notice: Subject to any disclaimer, the term of this patent is extended or adjusted under 35 U.S.C. 154(b) by 0 days.

(21) Appl. No.: 13/375,562

(22) PCT Filed: Jun. 4, 2010

(86) PCT No.: PCT/US2010/037390
§ 371 (c)(1),
(2), (4) Date: Feb. 27, 2012

(87) PCT Pub. No.: WO2010/141811
PCT Pub. Date: Dec. 9, 2010

(65) Prior Publication Data
US 2012/0149634 A1     Jun. 14, 2012

Related U.S. Application Data

(60) Provisional application No. 61/184,209, filed on Jun. 4, 2009.

(51) Int. Cl.
| | |
|---|---|
| A61K 38/10 | (2006.01) |
| A61K 38/08 | (2006.01) |
| A61P 19/08 | (2006.01) |
| A61P 19/10 | (2006.01) |
| C07K 7/08 | (2006.01) |
| C07K 7/06 | (2006.01) |
| A61K 38/04 | (2006.01) |

(52) U.S. Cl.
CPC .............. *A61K 38/10* (2013.01); *A61K 38/04* (2013.01); *A61K 38/08* (2013.01); *C07K 7/06* (2013.01); *C07K 7/08* (2013.01)

(58) Field of Classification Search
None
See application file for complete search history.

(56) References Cited

U.S. PATENT DOCUMENTS

| | | | | |
|---|---|---|---|---|
| 5,539,063 | A | * | 7/1996 | Hakimi et al. ............... 525/403 |
| 5,998,369 | A | * | 12/1999 | Khosla et al. ............... 424/10.1 |
| 7,504,374 | B2 | | 3/2009 | Marx et al. |
| 2004/0005579 | A1 | | 1/2004 | Birse et al. |

FOREIGN PATENT DOCUMENTS

| | | | |
|---|---|---|---|
| DE | 19757250 | * | 7/1999 |
| WO | WO 2005/014635 A2 | | 2/2005 |
| WO | WO 2006/034832 A2 | | 4/2006 |
| WO | WO 2006/102715 A1 | | 10/2006 |
| WO | WO 2008/019491 | | 2/2008 |
| WO | WO 2009/019254 | | 2/2009 |
| WO | WO 2009/059011 A2 | | 5/2009 |

OTHER PUBLICATIONS

Binkert et al., EMBO J., 1989, vol. 8(9):2497-2502.*
Heaney, R. P., Clin. Med. Res., 2003, vol. 1(2):93-99.*
Argente et al. "Multiple Endocrine Abnormalities of the Growth Hormone and Insulin-Like Growth Factor Axis in Prepubertal Children with Exogenous Obesity: Effect of Short- and Long-Term Weight Reduction" *J Clin Endocrinol Metab* 82:2076-2083 (1997).
Clemmons et al. "The Combination of Insulin-Like Growth Factor I and Insulin-Like Growth Factor-Binding Protein-3 Reduces Insulin Requirements in Insulin-Dependent Type 1 Diabetes: Evidence for in Vivo Biological Activity" *J Clin Endocrinol Metab* 85:1518-1524 (2000).
Fazeli et al. "Preadipocyte Factor-1 is Associated with Marrow Adiposity and Bone Mineral Density in Women with Anorexia Nervosa" *J Clin Endocrinol Metab* 95(1):407-413 (2010).
Fritton et al. "The Insulin-Like Growth Factor-1 Binding Protein Acid-labile Subunit Alters Mesenchymal Stromal Cell Fate" *The Journal of Biological Chemistry* 285(7):4709-4714 (2010).
Frystyk et al. "Circulating Levels of Free Insulin-Like Growth Factors in Obese Subjects: the Impact of Type 2 Diabetes" *Diabetes Metab Res Rev* 15:314-322 (1999).
Kawai et al. "A Circadian-Regulated Gene, Nocturnin, Promotes Adipogenesis by Stimulating PPAR-γ Nuclear Translocation" *PNAS* 107(23):10508-10513 (2010).
Kawai et al. "The Heparin-Binding Domain of IGFBP-2 Has Insulin-Like Growth Factor Binding-Independent Biologic Activity in the Growing Skeleton" *The Journal of Biological Chemistry* 286(16):14670-14680 (2011).
Khosla et al. "Use of Site Specific Antibodies to Characterize the Circulating Form of Big Insulin-Like Growth Factor II in Patients with Hepatitis C-Associated Osteosclerosis" *J Clin Endocrinol Metab* 87(8):3867-3870 (2002).
Maile et al. "An Essential Role for the Association of CD47 to SHPS-1 in Skeletal Remodeling" *Journal of Bone and Mineral Research* 26(9):2068-2081 (2011).
Nam et al. "Effect of Obesity on Total and Free Insulin-Like Growth Factor (IGF)-1, and Their Relationship to IGF-Binding Protein (BP)-1, IGFBP-2, IGFBP-3, Insulin, and Growth Hormone" *International Journal of Obesity* 21:355-359 (1997).

(Continued)

*Primary Examiner* — Xiaozhen Xie
(74) *Attorney, Agent, or Firm* — Myers Bigel Sibley & Sajovec, P.A.

(57) ABSTRACT

The present invention provides peptides and methods of their use in treating bone disorders and bone-related conditions and in treating obesity.

19 Claims, 16 Drawing Sheets

(56) References Cited

OTHER PUBLICATIONS

Sabin et al. "Dietary Monounsaturated Fat in Early Life Regulates IGFBP2: Implications for Fat Mass Accretion and Insulin Sensitivity" *Obesity* 19:2374-2381 (2011).

Touskova et al. "Serum Concentrations and Tissue Expression of Components of Insulin-Like Growth Factor-Axis in Females with Type 2 Diabetes Mellitus and Obesity: The Influence of Very-Low-Calorie Diet" *Molecular and Cellular Endocrinology* 361: 172-178 (2012).

Voskuil et al. Determinants of Circulating Insulin-Like Growth Factor (IGF)-I and IGF Binding Proteins 1-3 in Premenopausal Women: Physical Activity and Anthropometry (Netherlands) *Cancer Causes and Control* 12:951-958 (2001).

Wabitsch et al. "Insulin-Like Growth Factors and Their Binding Proteins Before and After Weight Loss and Their Associations with Hormonal and Metabolic Parameters in Obese Adolescent Girls" *Int J. Obes Relat Metab Disord.* 20(12):1073-1080 (1996) (Abstract Only).

Wheatcroft et al. "IGF-Dependent and IGF-Independent Actions of IGF-Binding Protein-1 and -2: Implications for Metabolic Homeostasis" *Trends in Endocrinology and Metabolism* 20(4):153-162 (2009).

Yakar et al. "Serum Complexes of Insulin-Like Growth Factor-1 Modulate Skeletal Integrity and Carbohydrate Metabolism" *FASEB J.* 23:709-719 (2009).

Breggia et al. "Global Deletion of IGFBP-2 Disrupts Hematopoiesis and Compromises Bone Marrow Engraftment in Lethally Irradiated Mice" Abstract of poster presented at the annual meeting of the Endocrine Society in San Diego, CA, Jun. 19-22, 2010.

Breggia et al. "IGFBP-2 from Mesenchymal Stromal Cells (MSCs) in the bone Marrow Niche Regulates Hematopoietic Stem Cell Proliferation and Marrow" Abstract of oral presentation at the annual ASBMR meeting in Toronto, Ontario, Canada, Oct. 15-19, 2010.

Breggia et al. "The Heparin Binding Domain of IGFBP-2 is an Important Regulator of Murine Hematopoiesis and Human Stem Cell Proliferation" Abstract of oral presentation at the annual ASBMR meeting in San Diego, CA, Sep. 16-20, 2011.

Breggia et al. " The Heparin Binding Domain of IGFBP-2 Increases Proliferation of Human Hematopoietic Stem Cells In Vitro" *Endocr Rev* 32:P1-138 (Jun. 2011) (Abstract).

International Search Report and Written Opinion of International Application No. PCT/US2010/037390, mailed Dec. 3, 2010 (14 pages).

Hoeflich et al. "Growth Inhibition in Giant Growth Hormone Transgenic Mice by Overexpression of Insulin-Like Growth Factor-Binding Protein-2" *Endocrinology* 142(5):1889-1898 (2001).

Huynh et al. "Insulin-Like Growth Factor-Binding Protein 2 Secreted by a Tumorigenic Cell Line Supports Ex Vivo Expansion of Mouse Hematopoietic Stem Cells" *Stem Cells* 26(6):1628-1635 (2008).

Amin et al. "High Serum IGFBP-2 is Predictive of Increased Bone Turnover in Aging Men and Women" *Journal of Bone and Mineral Research* 22(6):799-807 (2007).

Arai et al. "Binding of Insulin-Like Growth Factor (IGF) I or II to IGF-Binding Protein-2 Enables it to Bind to Heparin and Extracellular Matrix" *Endocrinology* 137(11):4571-4575 (1996).

Ballen et al. "The National Marrow Donor Program 20 Years of Unrelated Donor Hematopoietic Cell Transplantation" *Biology of Blood and Marrow Transplantation* 14:2-7 (2008).

Bendall et al. "IGF and FGF Cooperatively Establish the Regulatory Stem Cell Niche of Pluripotent Human Cells In Vitro" *Nature* 448:1015-1021 (2007).

Bennett et al. "Regulation of Osteoblastogenesis and Bone Mass by Wnt10b" *PNAS* 102(9):3324-3329 (2005).

Bhattacharya et al. "Purified Hematopoietic Stem Cell Engraftment of Rare Niches Corrects Severe Lymphoid Deficiencies Without Host Conditioning" *JEM* 203(1):73-85 (2006).

Calvi et al. "Osteoblastic Cells Regulate the Haematopoietic Stem Cell Niche" *Nature* 425:841-846 (2003).

Clawson et al. "Differential Expression of Insulin-Like Growth Factor Binding Proteins in Murine Hematopoietic Stromal Cell Lines" *Molecular and Cellular Endocrinology* 120:59-66 (1996).

Cohen et al. "Elevated Levels of Insulin-Like Growth Factor-Binding Protein-2 in the Serum of Prostate Cancer Patients" *Journal of Clinical Endocrinology and Metabolism* 76(4):1031-1035 (1993).

Conover et al. "Subcutaneous Administration of Insulin-Like Growth Factor (IGF)-II/IGF Binding Protein-2 Complex Stimulates Bone Formation and Prevents Loss of Bone Mineral Density in a Rat Model of Disuse Osteoporosis" *Growth Hormone & IGF Research* 12:178-183 (2002).

Czechowicz et al. "Efficient Transplantation Via Antibody-Based Clearance of Hematopoietic Stem Cell Niches" *Science* 318:1296-1299 (2007).

Dawczynski et al. "Changes of Serum Growth Factors (IGF-I,-II and IFGBP-2,-3) Prior to and After Stem Cell Transplantation in Children with Acute Leukemia" *Bone Marrow Transplantation* 32:411-415 (2003).

Dawczynski et al. "Elevated Serum Insulin-Like Growth Factor Binding Protein-2 is Associated With a High Relapse Risk After Hematopoietic Stem Cell Transplantation in Childhood AML" *Bone Marrow Transplantation* 37:589-594 (2006).

Delaney et al. "Notch-Mediated Expansion of Human Cord Blood Progenitor Cells Capable of Rapid Myeloid Reconstitution" *Nature Medicine* 16(2):232-237 (2010).

Demambro et al. "Gender-Specific Changes in Bone Turnover and Skeletal Architecture in *Igfbp*-2-Null Mice" *Endocrinology* 149(5):2051-2061 (2008).

Desbois-Mouthon et al. "Insulin and IGF-1 Stimulate the β-Catenin Pathway Through Two Signalling Cascades Involving GSK-3β Inhibition and Ras Activation" *Oncogene* 20:252-259 (2001).

Duan et al. "Insulin-Like Growth Factor Binding Protein 2 is a Growth Inhibitory Protein Conserved in Zebrafish" *PNAS* 96(26):15274-15279 (1999).

Eckstein et al. "Insulin-Like Growth Factor-Binding Protein-2 (IGFBP-2) Overexpression Negatively Regulates Bone Size and Mass, but not Density, in the Absence and Presence of Growth Hormone/IGF-I Excess in Transgenic Mice" *Anat Embryol* 206:139-148 (2002).

Eminli et al. "Differentiation Stage Determines Potential of Hematopoietic Cells for Reprogramming into Induced Pluripotent Stem Cells" *Nature Genetics* 41(9):968-976 (2009).

Fang et al. "Phosphorylation of β-Catenin by AKT Promotes β-Catenin Transcriptional Activity" *The Journal of Biological Chemistry* 282(15):11221-11229 (2007).

Firth et al. "Cellular Actions of the Insulin-Like Growth Factor Binding Proteins" *Endocrine Reviews* 23(6):824-854 (2002).

Forsberg et al. "Hematopoietic Stem Cells *Expression Profiling and Beyond"* Stem Cell Reviews* 2:23-30 (2006).

Frisch et al. "Hematopoietic Niche and Bone Meet" *Curr Opin Support Palliat Care* 2:211-217 (2008).

Frisch et al. "In Vivo Prostaglandin $E_2$ Treatment Alters the Bone Marrow Microenvironment and Preferentially Expands Short-Term Hematopoietic Stem Cells" *Blood* 114(19):4054-4063 (2009).

Fu et al. "Promotion of Cancer Cell Migration *An Insulin-Like Growth Factor (IGF)-Independent Action of IGF-Binding Protein-6" Journal of Biological Chemistry* 282(31):22298-22306 (2007).

Fujita et al. "Runx2 Induces Osteoblast and Chondrocyte Differentiation and Enhances Their Migration by Coupling with PI3K-Akt Signaling" *The Journal of Cell Biology* 166(1):8595 (2004).

Gesta et al. "Developmental Origin of Fat: Tracking Obesity to its Source" *Cell* 131:242-256 (2007).

Glass et al. "Molecular Bases of the Regulation of Bone Remodeling by the Canonical Wnt Signaling Pathway" *Current Topics in Developmental Biology* 73:43-84 (2006).

Glass et al. "Canonical Wnt Signaling in Differentiated Osteoblasts Controls Osteoclast Differentiation" *Developmental Cell* 8:751-764 (2005).

Haug et al. "N-Cadherin Expression Level Distinguishes Reserved Versus Primed States of Hematopoietic Stem Cells" *Cell Stem Cell* 2:367-379 (2008).

He et al. "PTEN-Deficient Intestinal Stem Cells Initiate Intestinal Polyposis" *Nature Genetics* 39(2):189-198 (2007).

(56) References Cited

OTHER PUBLICATIONS

Hedbacker et al. "Antidiabetic Effects of IGFBP2, a Leptin-Regulated Gene" *Cell Metabolism* 11:11-22 (2010).
Hoeflich et al. "Insulin-Like Growth Factor-Binding Protein 2 in Tumorigenesis: Protector or Promoter?" *Cancer Research* 61:8601-8610 (2001).
Hoeflich et al. "Mutation of the RGD Sequence Does Not Affect Plasma Membrane Association and Growth Inhibitory Effects of Elevated IGFBP-2 In Vivo" *FEBS Letters* 523:63-67 (2002).
Hu et al. "Serum Insulin-Like Growth Factor-1 Binding Proteins 1 and 2 and Mortality in Older Adults: The Health, Aging, and Body Composition Study" *J Am Geriatr Soc* 57:1213-1218 (2009).
Huynh et al. "Insulin-Like Growth Factor-Binding Protein 2 Secreted by a Tumorigenic Cell Line Supports Ex Vivo Expansion of Mouse Hematopoietic Stem Cells" *Stem Cells* 26:1628-1635 (2008).
Hwa et al. "The Insulin-Like Growth Factor-Binding Protein (IGFBP) Superfamily*" *Endocrine Reviews* 20(6):761-787 (1999).
Jenq et al. "Allogeneic Haematopoietic Stem Cell Transplantation: Individualized Stem Cell and Immune Therapy of Cancer" *Nat Rev Cancer* 10:213-221 (2010).
Jin et al. "Wnt and Beyond Wnt: Multiple Mechanisms Control the Transcriptional Property of β-Catenin" *Cellular Signalling* 20:1697-1704 (2008).
Jones et al. "Insulin-Like Growth Factors and Their Binding Proteins: Biological Actions*" *Endocr Rev* 16(1):3-34 (1995).
Kawai et al. "Insulin-Like Growth Factor-I and Bone: Lessons from Mice and Men" *Pediatr Nephrol* 24:1277-1285 (2009).
Kawai et al. "Growth Hormone Stimulates Adipogenesis of 3T3-L1 Cells Through Activation of the Stat5A/5B-PPARγ Pathway" *Journal of Molecular Endocrinology* 38:19-34 (2007).
Kearns et al. "Receptor Activator of Nuclear Factor κB Ligand and Osteoprotegerin Regulation of Bone Remodeling in Health and Disease" *Endocrine Reviews* 29(2):155-192 (2008).
Khosla et al. "Insulin-Like Growth Factor System Abnormalities in Hepatitis C-Associated Osteosclerosis" *J. Clin. Invest.* 101(10):2165-2173 (1998).
Kuznetsov et al. "The Interplay of Osteogenesis and Hematopoiesis: Expression of a Constitutively Active PTH/PTHrP Receptor in Osteogenic Cells Perturbs the Establishment of Hematopoiesis in Bone and of Skeletal Stem Cells in the Bone, Marrow" *The Journal of Cell Biology* 167(6):1113-1122 (2004).
Levitt et al. "PTEN-Induction in U251 Glioma Cells Decreases the Expression of Insulin-Like Growth Factor Binding Protein-2" *Biochemical and Biophysical Research Communications* 336:1056-1061 (2005).
Liu et al. "Mice Carrying Null Mutations of the Genes Encoding Insulin-Like Growth Factor I (*Igf-1*) and Type 1 IGF Receptor (*Igf1r*)" *Cell* 75:59-72 (1993).
Liu et al. "Functional Interaction Between Peroxisome Proliferator-Activated Receptor γ and β-Catenin" *Molecular and Cellular Biology* 26(15):5827-5837 (2006).
Liu et al. "Lifelong Accumulation of Bone in Mice Lacking Pten in Osteoblasts" *PNAS* 104(7):2259-2264 (2007).
Maile et al. "Modulation of Integrin Antagonist Signaling by Ligand Binding of the Heparin-Binding Domain of Vitronectin to the αVβ3 Integrin" *J. Cell. Biochem.* 105:437-446 (2008).
Mehrian-Shai et al. "Insulin Growth Factor-Binding Protein 2 is Candidate Biomarker for PTEN Status and PI3K/Akt Pathway Activation in Glioblastoma and Prostate Cancer" *PNAS* 104(13):5563-5568 (2007).
Mukherjee et al. "Akt Promotes BMP2-Mediated Osteoblast Differentiation and Bone Development" *Journal of Cell Science* 122:716-726 (2009).
Mukherjee et al. "Insulin-Like Growth Factor-Binding Protein-5 Inhibits Osteoblast Differentiation and Skeletal Growth by Blocking Insulin-Like Growth Factor Actions" *Molecular Endocrinology* 22(5):1238-1250 (2008).
Palermo et al. "Potentiating Role of IGFBP-2 on IGF-II Stimulated Alkaline Phosphatase Activity in Differentiating Osteoblasts" *Am J Physiol Endocrinol Metab* 286:E648-E657 (2004).

Peng et al. "Dwarfism, Impaired Skin Development, Skeletal Muscle Atrophy, Delayed Bone Development, and Impeded Adipogenesis in Mice Lacking Akt1 and Akt2" *Genes Dev* 17:1352-1365 (2003).
Perks et al. "IGF-II and IGFBP-2 Differentially Regulate PTEN in Human Breast Cancer Cells" *Oncogene* 26:5966-5972 (2007).
Playford et al. "Insulin-Like Growth Factor 1 Regulates the Location, Stability, and Transcriptional Activity of β-Catenin" *PNAS* 97(22):12103-12108 (2000).
Pulte et al. "Trends in Survival After Diagnosis with Hematologic Malignancy in Adolescence or Young Adulthood in the United States, 1981-2005" *Cancer* 115:4973-4979 (2009).
Rosen et al. "Congenic Mice with Low Serum IGF-I Have Increased Body Fat, Reduced Bone Mineral Density, and an Altered Osteoblast Differentiation Program" *Bone* 35:1046-1058 (2004).
Ross et al. "Inhibition of Adipogenesis by Wnt Signaling" *Science* 289:950-953 (2000).
Russo et al. "Insulin-Like Growth Factor Binding Protein-2 Binds to Cell Surface Proteoglycans in the Rat Brain Olfactory Bulb" *Endocrinology* 138(11):4858-4867 (1997).
Russo et al. "Basic Fibroblast Growth Factor Induces Proteolysis of Secreted and Cell Membrane-Associated Insulin-Like Growth Factor Binding Protein-2 in Human Neuroblastoma Cells" *Endocrinology* 140(7):3082-3090 (1999).
Russo et al. "Insulin-Like Growth Factor Binding Protein-2 Binding to Extracellular Matrix Plays a Critical Role in Neuroblastoma Cell Proliferation, Migration, and Invasion" *Endocrinology* 146(10):4445-4455 (2005).
Sakata et al. "Skeletal Unloading Induces Resistance to Insulin-Like Growth Factor-I (IGF-I) by Inhibiting Activation of the IGF-I Signaling Pathways" *J Bone Miner Res* 19(3):436-446 (2003).
Schutt et al. "Integrin-Mediated Action of Insulin-Like Growth Factor Binding Protein-2 in Tumor Cells" *Journal of Molecular Endocrinology* 32:859-868 (2004).
Shoba et al. "Inhibition of Phosphatidylinositol 3-Kinase and p70S6 Kinase Blocks Osteogenic Protein-1 Induction of Alkaline Phosphatase Activity in Fetal Rat Calvaria Cells" *Journal of Cellular Biochemistry* 88:1247-1255 (2003).
Song et al. "IIp45, an Insulin-Like Growth Factor Binding Protein 2 (IGFBP-2) Binding Protein, Antagonizes IGFBP-2 Stimulation of Glioma Cell Invasion" *PNAS* 100(24):13970-13975 (2003).
Taurin et al. "Phosphorylation of β-Catenin by Cyclic AMP-Dependent Protein Kinase" *The Journal of Biological Chemistry* 281(15):9971-9976 (2006).
Wang et al. "Role of IGF-I Signaling in Regulating Osteoclastogenesis" *J Bone Miner Res* 21(9):1350-1358 (2006).
Wang et al. "An Interaction Between Insulin-Like Growth Factor-Binding Protein 2 (IGFBP2) and Integrin α5 is Essential for IGFBP2-Induced Cell Mobility" *The Journal of Biological Chemistry* 281(20):14085-14091 (2006).
Wheatcroft et al. "IGF-Binding Protein-2 Protects Against the Development of Obesity and Insulin Resistance" *Diabetes* 56:285-294 (2007).
Wilson et al. "Bone-Marrow Haematopoietic-Stem-Cell Niches" *Nat Rev Immunol* 6:93-106 (2006).
Wood et al. "Selective Alterations in Organ Sizes in Mice with a Targeted Disruption of the Insulin-Like Growth Factor Binding Protein-2 Gene" *Molecular Endocrinology* 14(9):1472-1482 (2000).
Yakar et al. "Circulating Levels of IGF-1 Directly Regulate Bone Growth and Density" *J. Clin. Invest.* 110(6):771-781 (2002).
Zhang et al. "Osteoblast-Specific Knockout of the Insulin-Like Growth Factor (IGF) Receptor Gene Reveals an Essential Role of IGF Signaling in Bone Matrix Mineralization" *The Journal of Biological Chemistry* 277(46):44005-44012 (2002).
Zhang et al. "Angiopoietin-Like 5 and IGFBP2 Stimulate Ex Vivo Expansion of Human Cord Blood Hematopoietic Stem Cells as Assayed by NOD/SCID Transplantation" *Blood* 111(7):3415-3423 (2008).
Zhao et al. "Targeted Overexpression of Insulin-Like Growth Factor I to Osteoblasts of Transgenic Mice: Increased Trabecular Bone vol. Without Increased Osteoblast Proliferation*" *Endocrinology* 141(7):2674-2682 (2000).

(56) References Cited

OTHER PUBLICATIONS

Zia et al. "Monoclonal Antibody αIR-3 Inhibits Non-Small Cell Lung Cancer Growth In Vitro and In Vivo" *Journal of Cellular Biochemistry Supplement* 24:269-275 (1996).
Demambro V.E. et al., "OR13,5 IGFBP-2 null mice develop obesity and insulin resistance with aging", *Growth Hormone and IGF Research*, vol. 18, Sep. 2008, p. S26.
Demambro V.E. et al., "Serum IGFBP-2 (IGF binding protein-2) Is a Marker of Bone Turnover; In Vivo Evidence from the IGFBP-2 Null Male Mouse", ASBMR 29th Annual Meeting, *Journal of Bone and Mineral Research*, Sep. 2007, S71.
European Search Report Corresponding to European Application No. 10 78 4143; Dated: Feb. 1, 2013; 15 Pages.
Mark Silke et al., "Diversity of human insulin-like growth factor (IGF) binding protein-2 fragments in plasma: Primary structure, IGF-Binding properties, and disulfide bonding pattern", *Biochemistry*, 2005, vol. 44, No. 9, 3644-3652.

\* cited by examiner

VON KOSSA STAINING
IGFBP2+/+      IGFBP2-/-

ALP STAINING

IGFBP2+/+

IGFBP2-/-

COBs

ALP STAINING

CONTROL   PEG-HBD

BMSCs

ALIZARIN RED STAINING

CONTROL   PEG-HBD

ALIZARIN RED STAINING

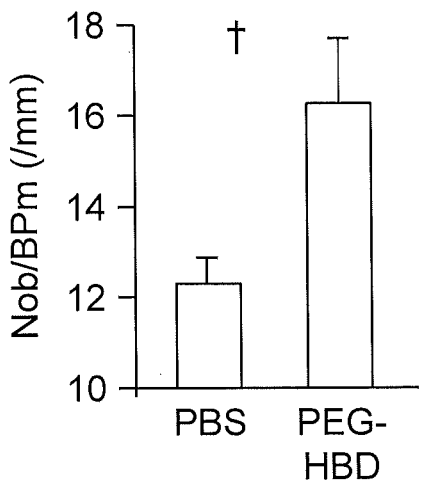
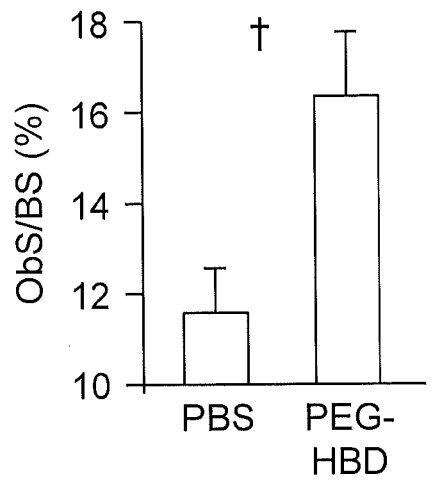
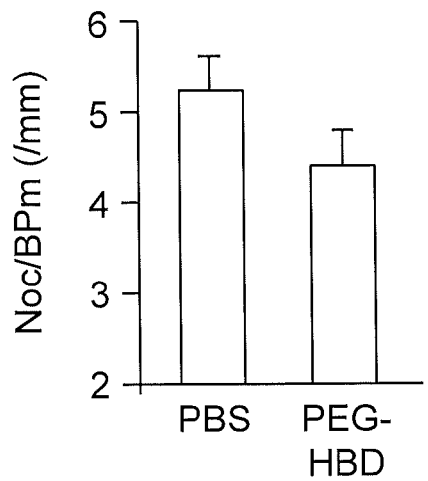
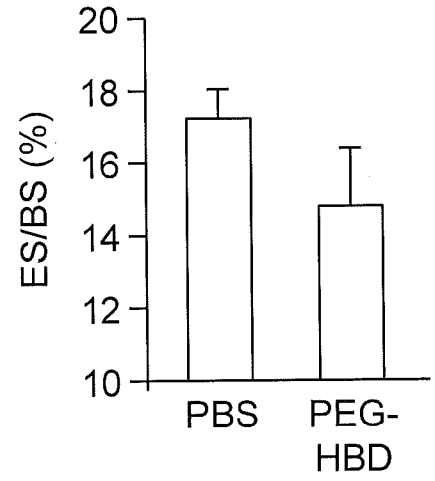
FIG. 4C
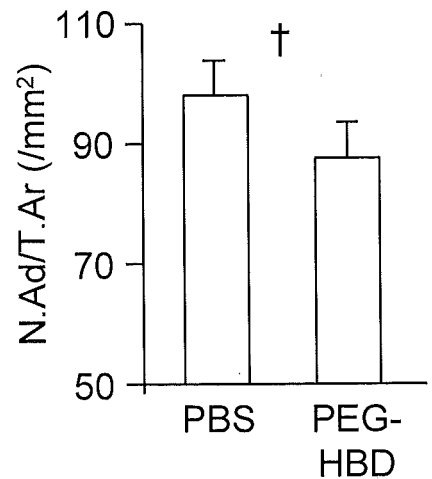
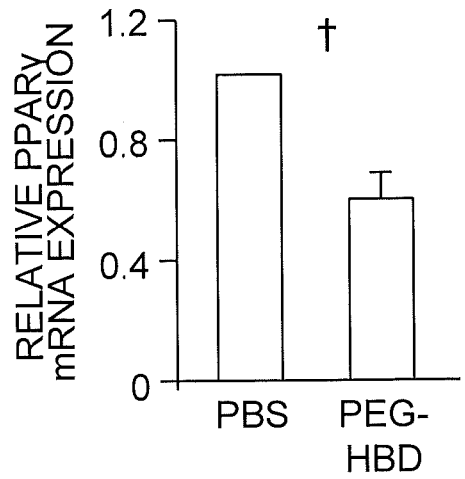
FIG. 4D      FIG. 4E

COMPOUNDS AND METHODS FOR TREATING BONE DISORDERS AND CONTROLLING WEIGHT

STATEMENT OF PRIORITY

This application is a 35 U.S.C. §371 national phase application of International Application Serial No. PCT/US2010/037390, filed Jun. 4, 2010, which claims the benefit, under 35 U.S.C. §119(e), of U.S. Provisional Application No. 61/184,209, filed Jun. 4, 2009, the contents of each of which are incorporated by reference herein in their entireties.

STATEMENT OF GOVERNMENT SUPPORT

This invention was made with government support under Grant Nos. AG002331 and HL056580 awarded by the National Institutes of Health. The government has certain rights in the invention.

STATEMENT REGARDING ELECTRONIC FILING OF A SEQUENCE LISTING

A Sequence Listing in ASCII text format, submitted under 37 C.F.R. §1.821, entitled 5470-528_ST25.txt, 2,135,089 bytes in size, generated on Apr. 22, 2013 and filed via EFS-Web, is provided in lieu of a paper copy. This Sequence Listing is hereby incorporated by reference into the specification for its disclosures.

FIELD OF THE INVENTION

The present invention concerns peptides, pharmaceutical formulations containing the same, and methods of use thereof in controlling weight, treating bone disorders and improving bone marrow reconstitution.

BACKGROUND OF THE INVENTION

Insulin-like growth factor binding protein-2 (IGFBP-2) is a 36,000 dalton protein that is a member of the IGFBP family. There are six forms of high affinity IGF binding proteins. In addition to binding the insulin-like growth factors I and II and acting as transport proteins, these proteins have been shown to have some actions that are independent of their ability to bind to IGFs.

IGFBP-2 is the second most abundant binding protein in serum. It circulates in concentrations in humans that vary between 100-600 ng/ml. Protein concentrations are high during fetal life and at birth and fall progressively during childhood and adolescence. There is a slight rise, an approximately 25% increase that occurs between 60-80 years. Serum concentrations of IGFBP-2 are regulated by hormones and nutrients. Fasting causes a significant increase in IGFBP-2 and feeding (particularly feeding protein) restores concentrations to normal. Concentrations are also suppressed by administration of insulin or growth hormone, and are increased by insulin-like growth factor-I. This is probably due in part to suppression of growth hormone and insulin, both of which are suppressed by administering IGF-I.

Proteolytic cleavage of IGFBP-2 results in small fragments that include the heparin binding domain (HBD). A small molecule containing the HBD present in the linker region of IGFBP-2 has been synthesized. Of the two HBDs in this molecule, the one synthesized is unique to IGFBP-2 and is not represented in other IGFBPs.

The present invention overcomes previous shortcomings in the art by providing peptides of IFGBP-2 and methods of their use in treating bone disorders, controlling weight and improving bone marrow reconstitution.

SUMMARY OF THE INVENTION

A first aspect of the invention is a compound comprising, consisting of or consisting essentially of the IGFBP-2 fragment KHHLGLEEPKKLR (SEQ ID NO:1), KHHLGLEEPKK (SEQ ID NO:2), HLGLEEPKKLR (SEQ ID NO:3), analogs thereof, prodrug of any thereof, or pharmaceutically acceptable salts of any thereof (all hereinafter sometimes referred to as "active compounds" or "active agents").

A second aspect of the invention is a composition comprising an active compound as described herein, which can be in combination with a pharmaceutically acceptable carrier, and optionally including at least one (e.g., 1, 2, 3, 4, 5, 6, 7, 8, 9, 10. etc.) additional active agent such as a bone resorption inhibitor or a weight control agent.

A further aspect of the invention is a method for inducing deposition and maturation of bone in a subject having a compromised bone condition, comprising administering the subject an active compound in an amount effective to induce deposition and maturation of bone in the subject. The method may further comprise concurrently administering a bone resorption inhibitor to the subject in an effective amount.

An additional aspect of the invention is a method for enhancing bone formation and inhibiting bone resorption simultaneously in a subject in need thereof, comprising administering to the subject an active compound in an amount effective to enhance bone formation and inhibit bone resorption simultaneously in said subject.

A further aspect of the invention is a method for controlling body weight in a subject in need thereof, comprising administering the subject an active compound as described herein in an amount effective to control body weight. The method may further comprise concurrently administering the subject an additional weight control agent.

Another aspect of the invention is a method for improving bone marrow reconstitution in a subject in need thereof, comprising administering to said subject an active compound of this invention in an amount effective to improve bone marrow reconstitution.

A further aspect of the invention is the use of an active compound as described herein for carrying out a method as described herein, and/or for the preparation of a medicament for carrying out a method as described herein.

The present invention is explained in greater detail below.

DETAILED DESCRIPTION OF THE INVENTION

Figure 1A:
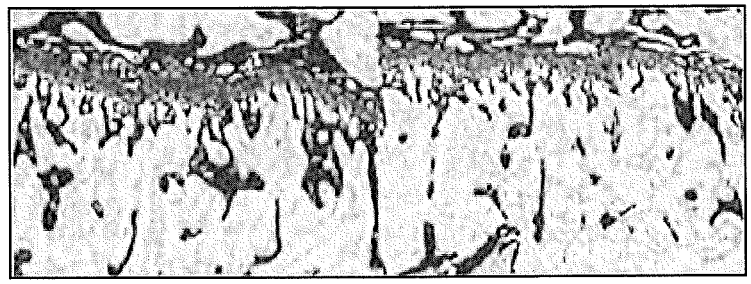
FIG. 1. The heparin-binding domain of IGFBP2 enhances osteoblastogenesis in vitro. a. Von Kossa staining was performed using tibia from 8 weeks old Igfbp2$^{+/+}$ and Igfbp2$^{-/-}$ male mouse. b. Calvarial osteoblasts (COBs) were harvested from day 7 old male Igfbp2$^{+/+}$ and Igfbp2$^{-/-}$ male mouse, and treated with osteogenic media in the presence of 2.5% FCS. At day 7, alkaline phosphatase (ALP) staining was performed. c and d. COBs and Bone marrow stromal cells (BMSCs) from Igfbp2$^{-/-}$ mouse were treated with osteogenic media with pegylated heparin-binding domain peptide (PEG-HBD) in the presence of 10% FCS. ALP staining (day 7) and Alizarin Red staining (day 14) were performed (c). RNA was isolated at day 14 from BMSCs and expression of ALP, osteocalcin (OC) and Runx2 was analyzed by real-time PCR. Figures shown represent at least 3 independent experiments (n=3). Statistical difference was analyzed by student's test. *; p<0.05.

The present invention is explained in greater detail below. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments suggested herein will be apparent to those skilled in the art in light of the instant disclosure which do not depart from the instant invention. Hence, the following specification is intended to illustrate some particular embodiments of the invention, and not to exhaustively specify all permutations, combinations and variations thereof.

The disclosures of all United States patents, patent publications and non-patent documents cited herein are incorporated herein by reference in their entirety.

The present invention is based on the discovery that peptides of IGFBP-2, (e.g., the heparin binding domain (HBD)) can be employed in methods of treating bone disorders, methods of weight control and methods of improving bone marrow reconstitution.

Thus, in certain embodiments, the present invention provides a method for enhancing bone formation (i.e., increasing the amount of new bone that is laid down) and inhibiting bone resorption (i.e., reducing the amount of bone that is dissolved) simultaneously in a subject in need thereof, comprising administering to the subject an active compound of this invention in an amount effective to enhance bone formation and inhibit bone resorption simultaneously in said subject. Nonlimiting examples of subjects for whom such treatment would be indicated and/or beneficial include women (e.g., post-menopausal; premenopausal) with osteoporosis or low bone mass, men with osteoporosis or low bone mass, subjects with a healing fracture, subjects undergoing prolonged immobilization, subjects who have been or are immobilized for a prolonged period, subjects likely to undergo or experience prolonged immobilization, subjects with estrogen deficiency, etc., as would be known in the art.

Also provided herein is a method for inducing deposition and maturation of bone in a subject in need thereof (e.g., a subject having a compromised bone condition), comprising administering to the subject an active compound of this invention in an amount effective to induce deposition and maturation of bone in the subject. The methods of this invention may further comprise concurrently administering a bone resorption inhibitor to the subject in an effective amount.

In some embodiments, a compromised bone condition is at a targeted site of the subject. The site may be an intervertebral space, a facet joint, a site of a bone fracture, bones of the mouth, chin and jaw, or an implant site.

Also provided herein is a method for improving bone marrow reconstitution in a subject in need thereof, comprising administering to said subject an active compound of this invention in an amount effective to improve bone marrow reconstitution (i.e., restoring (e.g., partially or fully) bone marrow cells in a subject, which can be, for example, a subject having chemotherapy, radiation or other treatments that deplete bone marrow cells. For example, a subject undergoing chemotherapy with or without radiation would benefit from more rapid restoration of cells in the bone marrow in order to prevent opportunistic infections. A subject of these methods can also be a subject having or suspected of having a hematologic disorder (e.g., aplastic anemia; myelodysplasia) that depletes bone marrow cells. Such an improvement or enhancement or increase in bone marrow reconstitution is in comparison to a subject to whom the active compound has not been administered.

In some embodiments, the methods of this invention can be employed in methods of ex vivo expansion of stem cells, carried out according to protocols known in the art. Thus, the present invention provides a method of expanding stem cells ex vivo, comprising contacting the compound of this invention with stem cells from a subject, wherein said stem cells are maintained under conditions whereby they are reintroduced into the subject.

For example in some ex vivo embodiments, the stem cells are obtained from a subject, e.g., a human, e.g., from peripheral blood, umbilical cord blood, or bone marrow, and the stem cells are contacted with the compound of this invention outside the body of the subject. Ex vivo embodiments include obtaining stem cells from a subject and culturing the cells for a period of time prior to use (e.g., for transplantation). In some embodiments, after contact with the compound, the cells are delivered to a subject, e.g., the same subject from which the cells were isolated (autologous donation) or a different subject (non-autologous (e.g., syngeneic or allogeneic) donation).

Nonlimiting examples of a subject for whom these methods would be indicated or beneficial include a subject having or who has had chemotherapy, a subject having or who has had radiation, a subject having aplastic anemia, a subject having myelodysplasia, and any combination thereof.

Administration of the compound or composition of this invention may be by any suitable route, including intrathecal injection, subcutaneous, cutaneous, oral, intravenous, intraperitoneal, intramuscular injection, in an implant, in a matrix, in a gel, or any combination thereof.

A bone condition that can be treated according methods of this invention may be one or more of broken bones, bone defects, bone transplant, bone grafts, bone cancer, joint replacements, joint repair, fusion, facet repair, bone degeneration, dental implants and repair, bone marrow deficits and other conditions associated with bone and boney tissue. Bone defects may be a gap, deformation and/or a nonunion fracture in a bone.

Bone degeneration may be due to osteopenia or osteoporosis (e.g. the patient is afflicted with geriatric or senile osteoporosis, with post-menopausal osteoporosis, etc.), or due to dwarfism.

Joint replacements that may be treated include vertebral, knee, hip, tarsal, phalangeal, elbow, ankle and/or other articulating joints or replacements thereof. Joint repairs include, but are not limited to, vertebral, knee, hip, tarsal, phalangeal, elbow, ankle, and sacroiliac joint repairs.

A further aspect of the invention is a method for controlling body weight in a subject in need thereof, comprising administering the subject an active compound as described herein in an amount effective to control body weight. The method may further comprise concurrently administering the subject an additional weight control agent.

In some embodiments, the subject is obese.

In some embodiments, the compound is administered in an amount effective to reduce weight gain or induce weight loss (or particularly fat loss) in the subject.

In some embodiments, the compound is administered in an amount effective to reduce the body mass index of the subject.

In some embodiments the subject has a body mass index of 25 or 30 kg/m$^2$ or above.

In some embodiments, the administering is continued for a period of at least 16 or 24 weeks, and/or until the individual has achieved at least 5% weight loss or the individual's body mass index is reduced to less than 25 kg/m$^2$.

In some embodiments, the active compound is administered in an amount effective to inhibit fat cell differentiation (e.g., inhibiting fat cell precursor differentiation into mature adipocytes) in the subject.

Some embodiments further comprise concurrently administering the subject an additional weight control agent.

The therapeutically effective dosage of any specific active compound of this invention will vary from compound to compound, and patient to patient, and will depend, among other things, upon the effect or result to be achieved, the condition of the patient and the route of delivery. In some embodiments, a dosage from about 0.001 (i.e., 1 ug/kg), 0.05, 0.1, 0.2, 0.3, 0.4, 0.5, 0.6, 0.7, 0.8, 0.9 or 1.0 mg/kg, up to about 30, 40 or 50 mg/kg (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 mg/kg), or more, may be used.

A. Definitions

"Subjects" as used herein are generally human subjects and includes, but is not limited to, post-menopausal subjects. The subjects may be male or female and may be of any race or ethnicity, including, but not limited to, Caucasian, African-American, African, Asian, Hispanic, Indian, etc. The subjects may be of any age, including newborn, neonate, infant, child, adolescent, adult, and geriatric. In some embodiments the subjects are post-menopausal female subjects, or subjects afflicted with senile osteoporosis. Subjects may also include animal subjects, particularly mammalian subjects such as canines, felines, bovines, caprines, equines, ovines, porcines, rodents (e.g. rats and mice), lagomorphs, primates (including non-human primates), etc., for veterinary medicine or pharmaceutical drug development purposes.

"Treat," "treating" or "treatment" as used herein refers to any type of treatment that imparts a benefit to a patient afflicted with a disease, including improvement in the condition of the patient (e.g., in one or more symptoms), delay in the progression of the disease, etc.

"Pharmaceutically acceptable" as used herein means that the compound or composition is suitable for administration to a subject to achieve the treatments described herein, without unduly deleterious side effects in light of the severity of the disease and necessity of the treatment.

"Concurrently administering" or "concurrently administer" as used herein means that the two or more compounds or compositions are administered closely enough in time to produce a combined effect (that is, concurrently may be simultaneously, or it may be two or more events occurring within a short time period before or after each other, e.g., sequentially). Simultaneous concurrent administration may be carried out by mixing the compounds prior to administration, or by administering the compounds at the same point in time but at different anatomic sites and/or by using different routes of administration.

"Bone resorption inhibitor" as used herein may be any suitable bone resorption inhibitor, including but not limited to a bisphosphonate, a selective estrogen receptor modulator, calcitonin, a vitamin D analog, and a calcium salt. See, e.g., U.S. Pat. No. 7,507,715. Numerous such compounds are known. See, e.g., U.S. Pat. Nos. 7,018,982; 6,723,696; 6,284,730; and 5,039,669.

"Weight control agent" as used herein includes any additional weight control active agent, including but not limited to appetite suppressants such as sibutramine, phentermine, diethylpropion, phendimetrazine, etc.; lipase inhibitors such as orilstat; antidepressants such as bupropion; anti-seizure agents such as topiramate, zonisamide, and metformin, etc.

"Capping group" as used herein includes, but is not limited to, acetyl, benzoyl, formyl, trifluoroacetyl, benzyloxycarbonyl, tert-butyloxycarbonyl, biphenylylisopropyloxycarbonyl, triphenylmethyl, o-nitrobenzenesulfenyl, and diphenylphosphinyl. The capping groups may consist of such groups as $R^{10}CO-$, $R^{10}-O-CO-$, $R^{10}-PO-$, $R^{10}-SO_2-$ and arylalkyl-; where $R^{10}$ is selected from the group consisting of H, alkyl, alkenyl, alkynyl, aryl, and arylalkyl.

"Linking group" or "linker" as used herein includes non-amino acid linking groups such as are known in the art (see, e.g., U.S. Pat. Nos. 7,468,418; 7402,652; and 7,351,797) or variations thereof that will be apparent to those skilled in the art.

"Alkyl," as used herein, refers to a straight or branched chain hydrocarbon containing from 1 to 10 carbon atoms. Representative examples of alkyl include, but are not limited to, methyl, ethyl, n-propyl, iso-propyl, n-butyl, sec-butyl, iso-butyl, tert-butyl, n-pentyl, isopentyl, neopentyl, n-hexyl, 3-methylhexyl, 2,2-dimethylpentyl, 2,3-dimethylpentyl, n-heptyl, n-octyl, n-nonyl, n-decyl, and the like. "Lower alkyl" as used herein, is a subset of alkyl and refers to a straight or branched chain hydrocarbon group containing from 1 to 4 carbon atoms. Representative examples of lower alkyl include, but are not limited to, methyl, ethyl, n-propyl, iso-propyl, n-butyl, iso-butyl, tert-butyl, and the like.

"Alkenyl," as used herein, refers to a straight or branched chain hydrocarbon containing from 2 to 10 carbons and containing at least one carbon-carbon double bond formed by the removal of two hydrogens. Representative examples of "alkenyl" include, but are not limited to, ethenyl, 2-propenyl, 2-methyl-2-propenyl, 3-butenyl, 4-pentenyl, 5-hexenyl, 2-heptenyl, 2-methyl-1-heptenyl, 3-decenyl and the like. "Lower alkenyl" as used herein, is a subset of alkenyl and refers to a straight or branched chain hydrocarbon group containing from 1 to 4 carbon atoms.

"Alkynyl," as used herein, refers to a straight or branched chain hydrocarbon group containing from 2 to 10 carbon atoms and containing at least one carbon-carbon triple bond. Representative examples of alkynyl include, but are not limited, to acetylenyl, 1-propynyl, 2-propynyl, 3-butynyl, 2-pentynyl, 1-butynyl and the like. "Lower alkynyl" as used herein, is a subset of alkyl and refers to a straight or branched chain hydrocarbon group containing from 1 to 4 carbon atoms.

The alkyl, alkenyl, and alkynyl groups of the invention can be substituted or unsubstituted and are either unless otherwise specified. When substituted the alkyl, alkenyl or alkynyl groups of the invention can be substituted with 1, 2, 3, 4, or 5 or more substituents independently selected from alkenyl, alkenyloxy, alkoxy, alkoxyalkoxy, alkoxycarbonyl, alkyl, alkylcarbonyl, alkylcarbonyloxy, alkylsulfinyl, alkylsulfonyl, alkylthio, alkynyl, aryl, azido, arylalkoxy, arylalkyl, aryloxy, carboxy, cyano, formyl, halogen, haloalkyl, haloalkoxy, hydroxy, hydroxyalkyl, mercapto, nitro, sulfamyl, sulfo, sulfonate, "Aryl" as used herein, refers to a monocyclic carbocyclic ring system or a bicyclic carbocyclic fused ring system having one or more aromatic rings. Representative examples of aryl include, azulenyl, indanyl, indenyl, naphthyl, phenyl, tetrahydronaphthyl, and the like.

The aryl groups of this invention can be substituted with 1, 2, 3, 4, or 5 or more substituents independently selected from alkenyl, alkenyloxy, alkoxy, alkoxyalkoxy, alkoxycarbonyl, alkyl, alkylcarbonyl, alkylcarbonyloxy, alkylsulfinyl, alkylsulfonyl, alkylthio, alkynyl, aryl, azido, arylalkoxy, arylalkyl, aryloxy, carboxy, cyano, formyl, halogen, haloalkyl, haloalkoxy, hydroxy, hydroxyalkyl, mercapto, nitro, sulfamyl, sulfo, sulfonate, "Arylalkyl," as used herein, refers to an aryl group, as defined herein, appended to the parent molecular moiety through an alkenyl group, as defined herein. Representative examples of arylalkenyl include, but are not limited to, 2-phenylethenyl, 3-phenylpropen-2-yl, 2-naphth-2-ylethenyl, and the like, which may be substituted or unsubstituted as noted above.

"Polyalkylene oxides" as used herein are known (see, e.g., U.S. Pat. No. 7,462,687) and include poly(ethylene glycol) or "PEG". Additional examples may contain hetero atoms such as S or N, and are typically linear polyalkylene oxides such as: O—(CH$_2$CH$_2$O)$_x$—, —O—C(O)CH$_2$—O—(CH$_2$CH$_2$O)$_x$—CH$_2$C(O)—O—, —NRCH$_2$CH$_2$-O—(CH$_2$CH$_2$O)$_x$—CH$_2$CH$_2$NR—, and —SHCH$_2$CH$_2$—O—(CH$_2$CH$_2$O)$_x$—CH$_2$CH$_2$SH—, wherein R is H or loweralkyl (preferably methyl), and x is an integer that provides or yields a total number average molecular weight for the molecule of from about 1,000, 2,000, 3,000, 4,000, 5,000, 6,000, 7,000, 8,000, 9,000, 10,000, 15,000, 20,000, 30,000, 40,000, 50,000, 60,000, 70,000, 80,000, 90,000 or 100,000 daltons or more.

"Analog" as used herein is a peptide that has the physiological activity of the parent compound thereof, and that includes one or more (e.g., two, three, four, five or six or more) amino acids different from the amino acid sequence of a naturally occurring parent peptide. Such an analog preferably has at least about 70% of the physiological activity of the parent peptide. Such different amino acids may be additions, substitutions, deletions, or combinations thereof, including addition of non-natural side-chain groups and backbone links. Modifications of peptides to produce analogs thereof are known. See, e.g., U.S. Pat. No. 7,323,543; see also U.S. Pat. Nos. 7,482,171; 7,459,152; and 7,393,919.

B. Active Compounds

The single letter code for amino acids as used herein is: A (Ala), C (Cys), D (Asp), E (Glu), F (Phe), G (Gly), H(His), I (Ile), K (Lys), L (Leu), M (Met), N (Asn), P (Pro), Q (Gln), R (Arg), S (Ser), T (Thr), V (Val), W (Trp), and Y (Tyr)).

Active compounds of the present invention are, in general, compounds (from amino or N terminus to carboxy or C terminus) of Formula I (SEQ ID NO:4):

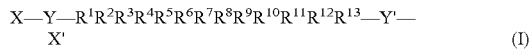

(I)

wherein:

X is present or absent and when present is a capping group, a polyalkylene oxide (e.g., a poly(ethylene glycol), "PEG"), or a peptide consisting of from 2 to 6 or 10 additional amino acids (of any type), which peptide is optionally terminated by a capping group or polyalkylene oxide;

Y is present or absent and when present is a linking group;

$R^1$ is present or absent and when present is a positively charged (at pH 6.0) amino acid, which can be an amino acid selected from the group consisting of K, R and H;

$R^2$ is present or absent and when present is a positively charged (at pH 6.0) amino acid, which can be an amino acid selected from the group consisting of K, R and H;

$R^3$ is any amino acid and in some embodiments is a positively charged (at pH 6.0) amino acid, which can be an amino acid selected from the group consisting of K, R and H;

$R^4$ is any amino acid and in some embodiments is an amino acid with a nonpolar side chain, which can be an amino acid selected from the group consisting of L, I or V;

$R^5$ is any amino acid and in some embodiments is G;

$R^6$ is any amino acid and in some embodiments is an amino acid with a nonpolar side chain, which can be an amino acid selected from the group consisting of L, I and V;

$R^7$ is any amino acid and in some embodiments is an amino acid selected from the group consisting of E and N;

$R^8$ is any amino acid and in some embodiments is an amino acid selected from the group consisting of E and N;

$R^9$ is any amino acid and in some embodiments is P;

$R^{10}$ is a positively charged (at pH 6.0) amino acid, which can be an amino acid selected from the group consisting of K, R and H;

$R^{11}$ is a positively charged (at pH 6.0) amino acid, which can be an amino acid selected from the group consisting of K, R and H;

$R^{12}$ is present or absent and when present is any amino acid and in some embodiments is an amino acid with a nonpolar side chain, which can be an amino acid selected from the group consisting of L, I or V;

$R^{13}$ is present or absent and when present is a positively charged (at pH 6.0) amino acid, which can be an amino acid selected from the group consisting of K, R and H;

Y' is present or absent and when present is a linking group; and

X' is present or absent and when present is a capping group, a polyalkylene oxide (e.g., PEG), or a peptide consisting of from 2 to 6 or 10 additional amino acids, which peptide is optionally terminated by a capping group or polyalkylene oxide.

Also provided herein is a pharmaceutically acceptable salt of the compound of Formula I.

Amino acids in peptides of the present invention may be in the D or L configuration: e.g., all D; all L; some D and some L in any combination.

In some embodiments, X is preferably a polyalkylene oxide, or a peptide consisting of from 2 to 6 or 10 additional amino acids, which peptide is terminated by polyalkylene oxide.

Nonlimiting examples of an active agent of this invention include KHHLGLEEPKKLR (SEQ ID NO:1), KHHL-GLEEPKK (SEQ ID NO:2), HLGLEEPKKLR (SEQ ID NO:3), analogs thereof, prodrug of any thereof, or pharmaceutically acceptable salts of any thereof.

Illustrative examples of the foregoing include, but are not limited to the peptides listed in Table 7 herein.

Additional examples of compounds of the present invention include all of the foregoing compounds, where the first one or two N-terminal amino acids are deleted.

Additional examples of compounds of the present invention include all of the foregoing compounds, with one, two or three additional C-terminal amino acids of any type coupled thereto.

Additional examples of compounds of the present invention include all of the foregoing compounds, with a 10,000 to 30,000 molecular weight of poly(ethylene glycol) (or "PEG") moiety coupled to either the N or C terminus thereof.

"Polyalkylene glycol" means straight or branched polyalkylene glycol polymers including, but not limited to, polyethylene glycol (PEG), polypropylene glycol (PPG), and polybutylene glycol (PBG), as well as co-polymers of PEG, PPG and PBG in any combination, and includes the monoalkylether of the polyalkylene glycol. Thus, in various embodiments of this invention, the polyalkylene glycol in the compositions of this invention can be, but is not limited to, polyethylene glycol, polypropylene glycol, polybutylene glycol, and any combination thereof.

In certain embodiments, the polyalkylene glycol of the composition is polyethylene glycol or "PEG." The term "PEG subunit" refers to a single polyethylene glycol unit, i.e., —($CH_2CH_2O$)—.

In some embodiments, the polyalkylene glycol (e.g., PEG) can be non-polydispersed, monodispersed, substantially monodispersed, purely monodispersed, or substantially purely monodispersed.

"Monodispersed" is used to describe a mixture of compounds wherein about 100 percent of the compounds in the mixture have the same molecular weight.

"Substantially monodispersed" is used to describe a mixture of compounds wherein at least about 95 percent of the compounds in the mixture have the same molecular weight.

"Purely monodispersed" is used to describe a mixture of compounds wherein about 100 percent of the compounds in the mixture have the same molecular weight and have the same molecular structure. Thus, a purely monodispersed mixture is a monodispersed mixture, but a monodispersed mixture is not necessarily a purely monodispersed mixture.

"Substantially purely monodispersed" is used to describe a mixture of compounds wherein at least about 95 percent of the compounds in the mixture have the same molecular weight and have the same molecular structure. Thus, a substantially purely monodispersed mixture is a substantially monodispersed mixture, but a substantially monodispersed mixture is not necessarily a substantially purely monodispersed mixture.

C. Pharmaceutical Formulations

The active compounds described above may be formulated for administration in a pharmaceutical carrier in accordance with known techniques. See, e.g., Remington, *The Science And Practice of Pharmacy* (9$^{th}$ Ed. 1995). In the manufacture of a pharmaceutical formulation according to the invention, the active compound (including the physiologically acceptable salts thereof) is typically admixed with, inter alia, an acceptable carrier. The carrier must, of course, be acceptable in the sense of being compatible with any other ingredients in the formulation and must not be deleterious to the patient. The carrier may be a solid or a liquid, or both, and is preferably formulated with the compound as a unit-dose formulation, for example, a tablet, which may contain from 0.01 or 0.5% to 95% or 99% by weight of the active compound. One or more active compounds may be incorporated in the formulations of the invention, which may be prepared by any of the well known techniques of pharmacy comprising admixing the components, optionally including one or more accessory ingredients.

The formulations of the invention include those suitable for oral, rectal, topical, buccal (e.g., sub-lingual), vaginal, parenteral (e.g., subcutaneous, intramuscular, intradermal, or intravenous), topical (i.e., both skin and mucosal surfaces, including airway surfaces) and transdermal administration, although the most suitable route in any given case will depend on the nature and severity of the condition being treated and on the nature of the particular active compound which is being used.

Formulations suitable for oral administration may be presented in discrete units, such as capsules, cachets, lozenges, or tablets, each containing a predetermined amount of the active compound; as a powder or granules; as a solution or a suspension in an aqueous or non-aqueous liquid; or as an oil-in-water or water-in-oil emulsion. Such formulations may be prepared by any suitable method of pharmacy which includes the step of bringing into association the active compound and a suitable carrier (which may contain one or more accessory ingredients as noted above). In general, the formulations of the invention are prepared by uniformly and intimately admixing the active compound with a liquid or finely divided solid carrier, or both, and then, if necessary, shaping the resulting mixture. For example, a tablet may be prepared by compressing or molding a powder or granules containing the active compound, optionally with one or more accessory ingredients. Compressed tablets may be prepared by compressing, in a suitable machine, the compound in a free-flowing form, such as a powder or granules optionally mixed with a binder, lubricant, inert diluent, and/or surface active/dispersing agent(s). Molded tablets may be made by molding, in a suitable machine, the powdered compound moistened with an inert liquid binder.

Formulations suitable for buccal (sub-lingual) administration include lozenges comprising the active compound in a flavoured base, usually sucrose and acacia or tragacanth; and pastilles comprising the compound in an inert base such as gelatin and glycerin or sucrose and acacia.

Formulations of the present invention suitable for parenteral administration comprise sterile aqueous and non-aqueous injection solutions of the active compound(s), which preparations are preferably isotonic with the blood of the intended recipient. These preparations may contain anti-oxidants, buffers, bacteriostats and solutes which render the formulation isotonic with the blood of the intended recipient. Aqueous and non-aqueous sterile suspensions may include suspending agents and thickening agents. The formulations may be presented in unit\dose or multi-dose containers, for example sealed ampoules and vials, and may be stored in a freeze-dried (lyophilized) condition requiring only the addition of the sterile liquid carrier, for example, saline or water-for-injection immediately prior to use. Extemporaneous injection solutions and suspensions may be prepared from sterile powders, granules and tablets of the kind previously described. For example, in one aspect of the present invention, there is provided an injectable, stable, sterile composition comprising an active compound(s), or a salt thereof, in a unit dosage form in a sealed container. The compound or salt is provided in the form of a lyophilizate which is capable of being reconstituted with a suitable pharmaceutically acceptable carrier to form a liquid composition suitable for injection thereof into a subject. The unit dosage form typically comprises from about 10 mg to about 10 grams of the compound or salt. When the compound or salt is substantially water-insoluble, a sufficient amount of emulsifying agent which is physiologically acceptable may be employed in sufficient quantity to emulsify the compound or salt in an aqueous carrier. One such useful emulsifying agent is phosphatidyl choline.

Formulations suitable for rectal administration are preferably presented as unit dose suppositories. These may be prepared by admixing the active compound with one or more conventional solid carriers, for example, cocoa butter, and then shaping the resulting mixture.

Formulations suitable for topical application to the skin preferably take the form of an ointment, cream, lotion, paste, gel, spray, aerosol, or oil. Carriers which may be used include petroleum jelly, lanoline, polyethylene glycols, alcohols, transdermal enhancers, and combinations of two or more thereof.

Formulations suitable for transdermal administration may be presented as discrete patches adapted to remain in intimate contact with the epidermis of the recipient for a prolonged period of time. Formulations suitable for transdermal administration may also be delivered by iontophoresis (see, for example, *Pharmaceutical Research* 3 (6):318 (1986)) and typically take the form of an optionally buffered aqueous solution of the active compound. Suitable formulations comprise citrate or bis\tris buffer (pH 6) or ethanol/water and contain from 0.1 to 0.2M active ingredient.

Further, the present invention provides liposomal formulations of the compounds disclosed herein and salts thereof. The technology for forming liposomal suspensions is well known in the art. When the compound or salt thereof is an aqueous-soluble salt, using conventional liposome technology, the same may be incorporated into lipid vesicles. In such an instance, due to the water solubility of the compound or salt, the compound or salt will be substantially entrained within the hydrophilic center or core of the liposomes. The lipid layer employed may be of any conventional composition and may either contain cholesterol or may be cholesterol-free. When the compound or salt of interest is water-insoluble, again employing conventional liposome formation technology, the salt may be substantially entrained within the hydrophobic lipid bilayer which forms the structure of the liposome. In either instance, the liposomes which are produced may be reduced in size, as through the use of standard sonication and homogenization techniques.

Of course, the liposomal formulations containing the compounds disclosed herein or salts thereof, may be lyophilized to produce a lyophilizate which may be reconstituted with a pharmaceutically acceptable carrier, such as water, to regenerate a liposomal suspension.

Other pharmaceutical compositions may be prepared from the water-insoluble compounds disclosed herein, or salts thereof, such as aqueous base emulsions. In such an instance, the composition will contain a sufficient amount of pharmaceutically acceptable emulsifying agent to emulsify the desired amount of the compound or salt thereof. Particularly useful emulsifying agents include phosphatidyl cholines, and lecithin.

In addition to active compound(s), the pharmaceutical compositions may contain other additives, such as pH-adjusting additives. In particular, useful pH-adjusting agents include acids, such as hydrochloric acid, bases or buffers, such as sodium lactate, sodium acetate, sodium phosphate, sodium citrate, sodium borate, or sodium gluconate. Further, the compositions may contain microbial preservatives. Useful microbial preservatives include methylparaben, propylparaben, and benzyl alcohol. The microbial preservative is typically employed when the formulation is placed in a vial designed for multidose use. Of course, as indicated, the pharmaceutical compositions of the present invention may be lyophilized using techniques well known in the art.

The present invention is illustrated in the following non-limiting examples.

EXAMPLES

Initial studies showed that when some cell types were exposed to IGFBP-2, it could enhance the ability of IGF-I to stimulate DNA synthesis and growth. In contrast other labs showed that high concentrations of the native protein often inhibited the ability of IGF-I to stimulate growth.

The studies described herein have focused on IGF independent actions of IGFBP-2 that are independent of its ability to inhibit IGF-I binding to its receptor and inhibit growth. Specifically it has been shown in mice in which the IGFBP-2 gene had been deleted that they had reduced bone turnover as reflected by histologic examination of the bones following tetracycline labeling and that cortical thickness and trabecular thickness were also reduced as evidenced by DEXA scanning, PIXI scanning and microCT analysis. A molecular explanation for this phenomenon was provided by the observation that both aortic smooth muscle and bone cells removed from these animals showed high concentrations of the growth inhibitor PTEN and that exogenous addition of IGFBP-2 or the 13 amino acid peptide described herein could suppress PTEN concentrations, thus leading to enhanced activation of the PI-3 kinase/AKT pathway which is necessary for growth stimulation. Other workers have also suggested that IGFBP-2 may stimulate stem cells. Lodish and Zhang demonstrated that IGFBP-2 was a potent stem cell growth factor and could stimulate hematopoetic stem cell reconstitution after bone marrow ablation with radiation therapy. These investigators did not investigate whether any fragments of IGFBP-2 or any portions of the protein had this property.

Example 1

Peptide Sequences

The amino acid sequence of a 13 amino acid peptide of the invention is as follows:

```
KHHLGLEEPKKLR.          (SEQ ID NO: 1)
```

The amino acid sequence of an 11 amino acid peptide of the present invention (a fragment of SEQ ID NO: 1 that retains biological activity) is as follows:

```
KHHLGLEEPKK.            (SEQ ID NO: 2)
```

The amino acid sequence of an 11 amino acid peptide of the present invention (a fragment of SEQ ID NO: 1 that retains biological activity) is as follows:

```
HLGLEEPKKLR             (SEQ ID NO: 3)
```

Variations on the foregoing sequences that are biologically active include substitutions that can be made for the K or H in positions 1, 2, and 3 (positions referring to SEQ ID NO: 1) with arginine or lysine, and which retain activity. Similarly, substitutions can be made for L at position 4 and 6 with I or V. Substitutions can be made at positions 7 or 8, for either E, with N. Substitutions can be made at positions 10 and 11 with either H or R. Substitutions can be made at position 12 with L for I or V, and at position 13 for R with K or H.

The rationale for picking this particular region of the IGFBP-2 protein was primarily based on certain factors. The first is its charge density; that is, the peptide contains 6 basic residues in 13 positions and 2 acidic residues. This gives it an extremely high charge density. Secondly, it is flanked by a polyproline sequence, which indicates it is held in rigid position by the parent protein. Third, this sequence is unique for IGFBP-2. The IGFBP family contains 6 members that have a high degree of sequence conservation at the N terminus and C terminus of the proteins. However, the mid region of each protein shows sequence divergence. This 13 amino acid sequence is completely unique for IGFBP-2 and is not contained in any of the other 6 IGF binding proteins. The importance of this is that knockout of IGFBP-2 in mice gives a unique phenotype: low bone turnover and high fat mass. Knockout of any of the other 5 IGF binding proteins does not give this phenotype. Therefore, it was hypothesized that there was a region within IGBP-2 that accounted for these effects.

Example 2

Preparation of Pegylated Peptide

The 13 amino acid peptide of SEQ ID NO: 1 described herein was prepared by solid phase synthesis, purified by HPLC, and then assessed for purity using mass spectrometry. Poly(ethylene glycol) ("PEG") was purchased from JenKem Technology USA (2033 W. McDermott Dr., Suite 320 #188, Allen, Tex. 75013-4675). 10.3 mg of the peptide was dissolved in 1.0 ml of 50 mM sodium phosphate pH 6.5. 406 mg of methoxyPEG propinaldehyde molecular weight 20 kDa was dissolved in 4 ml of 50 mM sodium phosphate. 120 ul of a 1M solution of sodium cyanoborhydride, tetrahydrofuran (Aldridge) was added to the solution of PEG. 1 ml of peptide was then added to the PEG solution, followed by additional 1 ml of sodium phosphate. The reaction mixture was then rotated in a 15 ml conical tube for 24 hours at 4° C. Following incubation, Tris base was added to a final concentration of 6.8 mM to block unreacted sites. N-terminal peglyation was verified by SDS-PAGE followed by Coumassie staining, which yielded a molecular weight that was consistent with 1 PEG molecule added per molecule of peptide. The compound was also analyzed by immunoblotting using an antibody that had been specifically prepared against the 13 amino acid sequence. The electrophoretic mobility of the Coumassie stained protein and the immunoblotted protein were identical, indicating that the immunoreactive peptide had been pegylated.

Example 3

Fat Cell Assays

In some assays, fat cell data were obtained by using the cell line 3T3L1, which is used to study fat cell differentiation. These cells are grown as fat cell precursors. These cells are maintained in Hams F12 with fetal calf serum and 15 mM glutamine. To stimulate them to enter the fat cell differentiation pathway, isomethylbutylxanine, dexamethasone and insulin are added using concentrations of 0.5 mM IBMX 16.7 nM insulin and 0.1 uM dexamethasone. In some cases 100 ng/ml IGF-I was added instead of insulin. Three days after the addition, differentiation into adipocytes is apparent and is detected by oil red O staining.

To determine the effects of the peptide of SEQ ID NO:1, it was added at concentrations of 20 ng/ml, 200 ng/ml and 2 ug/ml. A detectable inhibition of adipocyte differentiation, as determined by a decrease in the number of oil red O positive cells, was detected using 20 ng/ml of peptide. The response was maximal at 200 ng/ml and not increased further by adding 2 mcg/ml. Wildtype IGFBP-2 was tested in parallel and was found to also inhibit adipocyte differentiation using concentrations between 50-500 ng/ml.

For oil red O staining, a stock solution of 0.5 ml/100 ml isoproponol is prepared. 60 ml of solution is mixed with 40 ml of water and allowed to sit at room temperature for an hour and then filtered. The media is aspirated from the adipocyte cultures and cells are fixed in 1% formaldehyde. Formaldehyde is aspirated and the oil red O solution is added in an amount necessary to cover the cells, which are then left at room temperature for one hour. The stain is then removed and the plates are washed with distilled water and dried. Typically 60-70% of the cells stain positive after 3 days.

The maximum effect of the peptide was to inhibit differentiation to a level wherein <20% of the cells were positive. These findings were reconfirmed using primary mouse preadipocytes. 35-50 day old mice were killed and inguinal fat pads were removed aseptically. Fat tissue was washed and dissolved in Hanks basic salt solution containing 0.1% glucose and 2 mg/ml collagenase, (type 3 Worthington) and 4% BSA. Following 15 min digestion at 37°, the tissue was separated by dispersion and pipetting and then filtered through an 80 micron sterile nylon filter. The cells were then plated in DMEM F12 containing 10% fetal calf serum and then centrifuged at 700×g to separate the stromal vascular cells from the adipocytes, which float. The supernatant was discarded and the cell pellet which contained the stromal vascular cells was resuspended in DMEM F12 with 10% FCS and plated at a density of 15,000 cells/cm$^2$. The medium was aspirated 24 hr later and fresh medium was replaced every 3 days until the cells reached 80-90% confluence. Differentiation was induced by adding serum free medium containing 25 mM glucose, 10 ug/ml transferin, 10 nM T3, 10-7 dexamethasone, 5 ug/ml HDL and 16.7 nM insulin. This was added to cultures that were between 30-50% confluent. Medium was replaced every 3 days until fat droplets were observed, usually 6-8 days. They were then confirmed by oil Red O staining as described previously. The peptide was tested at concentrations between 2 ng and 2 ug/ml and native IGFBP-2 protein between 50-500 ng/ml. The IGFBP-2 had been purified from cellular conditioned medium and was determined to be homogenous by amino acid sequence analysis.

Example 4

Measurement of Osteoclast Differentiation

The method for osteoclast differentiation is as follows: Balb/c mice in which the IGFBP-2 gene had been deleted (see V. DeMambro et al, *Endocrinology*, 149(5): 2051-2061 (2007)) were anesthetized and sacrificed using cervical dislocation. The femurs from each mouse were dissected free of soft tissue and the bone marrow aspirated by needle puncture. Cells were removed sterile and resuspended in DMEM with 10% fetal calf serum. The cells were centrifuged at 700×g and the cell pellet resuspended in medium and plated in 24 well plates at a concentration of 5000 cells/cm$^2$. The plates that are used are low adherence plates that have no additives to facilitate cell adherence. Under these conditions macrophages will adhere while other cells will not. The media is supplemented with mCSF 20 ng/ml. After 3 days the cells are removed from the plate and the adherent macrophages are exposed to fresh media containing 10% FBS and mCSF. This is repeated again after 3 days and then after an additional 3 days cells are trypsinized and replated in fresh plates at $6\times10^4$ cells/cm. At this time RANK ligand, 50 ng/ml, is added, although in some experiments concentrations as low as 10 ng/ml were utilized. Medium is changed at 3 and 6 days and on day 7 cells are stained for tartrate resistant acid phosphatase, a marker of osteoclast differentiation. IGFBP-2 was added at concentrations between 50 ng/ml and 500 mcg/ml. The peptide was added at 20 or 200 ng/ml.

The results showed that the cells would not differentiate into osteoclasts without addition of the peptide or native IGFBP-2. Additionally, in the presence of the peptide, the serum concentration could be lowered to as low as 0.5% and osteoclast differentiation was still detected. Additionally, if 2% serum was utilized, mCSF could be deleted from the medium and RANK ligand lowered to as low at 30 ng/ml. However it was not possible to remove IGFBP-2. That is, cultures maintained without IGFBP-2 or the peptide did not differentiate into osteoclasts.

For tartrate resistant acid phosphatase staining, a 1% solution is prepared and incubated with the cells for 30 min at room temperature. Cultures are then washed and cell number determined by manual counting. In some experiments the pegylated 13 amino acid peptide was compared to the nonpegylated peptide and found to have equal biologic activity.

Example 5

Measurement of Osteoblast Differentiation

For measurement of osteoblast differentiation, the cells are also derived from the same bone marrow aspirates. However in some experiments they were derived from calvaria obtained from newborn animals. Cells are plated in 6 well plates at $20\times10^6$ cells/well in alpha MEM with 10% fetal bovine serum. Media was changed on day 1 and 3. At day 3 the cells received differentiation medium, which is alpha-MEM containing 10% fetal calf serum, 8 mM glycerol phosphate and 50 ug/ml ascorbic acid. Media subsequently is changed every 2 days until termination of the experiment, generally at 18 days. In some experiments fetal calf serum concentration was lowered to either 5% or 2%. IGFBP-2 200 ng/ml was added to some cultures or the IGFBP-2 peptide at concentrations between 2 ng/ml and 2 mcg/ml. To determine osteoblast differentiation, the cells were fixed with 4% paraformaldehyde and then stained for alkaline phosphatase. The cells were then counterstained with von kossa stain to detect mineralization. In some experiments the pegylated 13 amino acid peptide was compared to the nonpegylated peptide and found to have equal biologic activity.

Example 6

Bone Growth and Mineralization Studies

This system uses an ex vivo explant system, therefore it is a transition between cultured cells and in vivo experiments. The bone forming tissue is removed directly from a mouse and then grown in organ culture for several days. The test additives can be added directly to the medium at any concentration in order to test for biological activity. The method is as follows: mouse metatarsal bones were isolated from newborn mice between days 0 and 3 after birth using the dissecting microscope. The middle three metatarsals were used for all experiments. Three metatarsals were incubated per well in a 24 well tissue culture dish in DMEM containing 0.5% bovine serum, 0.5M ascorbic acid, 1 mM beta glycerol phosphate at 37° C. The medium was replaced one day later and the metatarsals are cultured for up to 10 days. Growth was measured by quantitative increase in size, both length and width of the bones using an inverted phase microscope with a built in micrometer scaling bar for measurements. Mineralization was assessed by the addition of calcein (500 ng/ml) to the medium for 2 hrs prior to tissue fixation. Fluorescent images were captured using a digital camera attached to an inverted microscope and quantifying calcein fluorescence under the appropriate weight length stimulus. Bone and cartilage histology were measured by fixing the bones in 4% PFA overnight and storing at 70% ethanol, followed by parafilm embedding sectioning and staining. Sections were stained with H&E, Alizaran red or alkaline phosphatase. For analysis of proteins, the tissue was homogenized in Laemmli sample buffer and gels were run using standard SDS polyacrylamide gel electrophoresis and western blotting.

Results demonstrated that addition of either intact IGFBP-2 or the IGFBP-2 peptide at a concentration of 20-200 ng/ml stimulated bone growth and calcification in metatarsals derived from the IGFBP-2-/- mice. The peptide also had a modest additional stimulatory effect on metatarsals from normal, but the percent increase was much greater in the metatarsals derived from the IGFBP-2 null animals.

Example 7

In Vivo Rescue of the Bone Phenotype in IGFBP-2-/- Mice

IGFBP-2-/- mice have reduced bone mineral density, reduced cortical and trabecular thickness and reduced bone turnover, both formation and resorption. To determine if the 13 amino acid peptide was active systemically, a pegylated preparation was prepared in order to extend halflife. This preparation was then injected into the mice. Mice between the ages of 16 and 20 weeks were utilized. These mice are known to have a major bone phenotype. The peptide was injected at a dose of 50 mcg of peptide plus conjugate, that is the total molecular weight of PEG plus the peptide, which is approximately 23,000 molecular weight was injected intraperitoneally five days per week for three weeks. Six mice were injected in each group. The major measure of bone density is the bone volume over total volume as calculated by micro CT analysis. This measures the amount of total bone within a given space. Control animals receive PBS injections.

The BV/TV values were as follows: For the normal mice, the value of the volume occupied by bone was 0.22 (22%); for the mice, with the IGFBP-2 gene deletion, the value was 0.12; and for mice that received the peptide, it was 0.18. Therefore, injection of the peptide rescued the bone phenotype to within 70% of normal even though these mice had gone the first 6 weeks of life without exposure to this protein. Measurement of the cortical thickness also showed that it was substantially increased by administration of the peptide. Analysis of the bones biochemically showed that PTEN was downregulated. Therefore it appears that the peptide is fully capable of rescuing a bone phenotype in a whole animal model.

Example 8

The Heparin Binding Domain of IGFBP2 is Anabolic to the Skeleton and Works Through a Mechanism that is Independent of IGF-I Binding Mice.

Generation of the original mixed background strain, B6; 129-Igfbp2<tm1Jep>, which are refer to Igfbp2$^{-/-}$ mice, has been described previously[10,52]. The original mice were backcrossed onto C57BL/6J background for at least 10 generations. All in vivo and ex vivo experimental studies were performed using male mice. All the animal studies were reviewed and approved by the Institutional Animal Care and Use Committee of Maine Medical Center Research Institute. Mice had free access to water and diet for the duration of the study. Colony environmental conditions included 14:10 hour light:dark cycles.

Cell Culture.

Neonatal calvarial osteoblasts were collected from 7-10 day old mice as previously described[53]. Briefly, calvariae were digested 5 times with collagenase P and Trypsin. Cells released from digests 2 through 5 were collected as primary calvarial osteoblasts, and maintained in DMEM supplemented with 10% FCS and non-essential amino acids. Osteoblastogenesis of primary calvarial osteoblasts was carried out by treating cells with 4 mM β-glycerophosphate and 50 μg/ml ascorbic acid in αMEM. Bone marrow stromal cells (BMSCs) were harvested from femurs and tibias of 8 weeks old mice as described previously[10]. Osteoblastogenesis of BMSCs was induced by the treatment with osteogenic media consisting of αMEM containing 10% FCS, 8 mM β-glycerophosphate, and 50 μg/ml ascorbic acid.

Metacarpal Culture.

Metacarpals were isolated from Igfbp2$^{-/-}$ mice at 1-day old and incubated in DMEM containing 0.5% BSA, 50 μg/ml ascorbic acid and 1 mM β-glycerol phosphate for 10 days[54]. Stimulants were added to culture media from day 1. At day 10, metacarpals were incubated in media containing calcein (500 ng/ml) for 2 hours for staining of calcium deposition, and images were obtained. Then, bones were fixed with 4% PFA, embedded in paraffin, and processed for Alcian blue and von Kossa double staining.

Real-Time PCR.

Total RNA was prepared using RNeasy Mini Kit (Qiagen) and treated with DNase (Qiagen). cDNA was generated using a random hexamer and reverse transcriptase (Superscript III, Invitrogen) according to the manufacturer's instructions. Quantification of mRNA expression was carried out using an iQ SYBR Green Supermix in a iQ5 thermal cycler and detection system (Bio-Rad). 18S rRNA or Gapdh was used as an internal standard control gene for all quantification.

Western Blot Analysis.

To prepare whole cell lysates, cells were solubilized in RIPA buffer[55]. For cytosolic fraction, cells were solubilized with hypotonic buffer containing protease and phosphatase inhibitors (10 mM Tris, 0.2 mM $MgCl_2$, pH 7.4) and kept on ice for 10 min. Cell lysates were mixed with sucrose buffer (final concentration; 25 mM Sucrose, 0.1 mM EDTA) and centrifuged at 20,000×g for 1 hour. Supernatant was used as cytosolic fraction. To prepare the membrane fraction, cells were solubilized with PBS containing protease and phosphatase inhibitors. The lysates were frozen at −80° C. for 1 h and thawed at room temperature. After three cycles, they were centrifuged at 13,000×g for 25 min. The pellet was suspended with membrane protein isolation buffer (20 mM Tris-HCl; 150 mM NaCl; 1 mM EDTA; 1 mM EGTA; and 1% Triton X-100, pH 7.5) containing protease and phosphatase inhibitors. Protein concentration was assessed by BCA protein assay kit (Thermo Scientific) and equal amounts of sample were separated by SDS-PAGE and transferred electrophoretically to nitrocellulose membranes. Membranes were blocked in 5% BSA in Tris-buffered saline. Thereafter, the membranes were immunoblotted with anti-PTEN (Cell signaling, #9559), anti-Akt (Cell signaling, #9272), anti-pSer473-Akt (Cell signaling, #9271), anti-β-catenin (BD Transduction Laboratories, 610153), anti-pSer552-β-catenin (Cell signaling, #9566P), or anti-α-actin (Santa Cruz, sc-47778), and developed with horseradish peroxidase-coupled anti mouse or rabbit IgG antibodies, followed by enhancement with SuperSignal West Dura Extended Duration Substrate Antibodies (Pierce Chemical Co.).

Generation of Heparin-Binding Domain Peptide.

The synthetic peptide containing the mouse homologue of the heparin binding domain (AA246-249) and 9 additional amino acids of mouse IGFBP-2, $^{237}$KHLSLEEPKKLRP$^{250}$ (SEQ ID NO:8753, referred to as HBD-peptide), and control peptide for HBD-peptide (AALSLEEPAALAP; SEQ ID NO:8754) were synthesized by the Protein Chemistry Core Facility at the University of North Carolina at Chapel Hill. The synthetic peptide for heparin-binding domain of IGFBP-5 ($^{201}$(RKGFYKRKQCKPSRGKRK$^{218}$; SEQ ID NO:8755) was generated in the same way. Purity and sequence confirmation were determined by mass spectrometry. The IGFBP-2 HBP-peptide was pegylated as follows: 10 mg of peptide was mixed with 380 ug of methoxy PEG maleimide (20000 kDa)(1:3 molar ratio peptide to PEG) (Jenkem Biotechnology) in 4.0 ml of 0.05M $NaH_2PO_4$, pH 7.0. Following an overnight incubation at 4° C., cysteine was added to a final concentration of 17 mM to block unreacted sites. To remove the nonpegylated peptide and cysteine the mixture was desalted using a Zebra Desalt spin column (Thermo Scientific) following the manufacturer's instructions. Pegylation was verified by SDS-PAGE analysis with Coomassie staining.

In Vivo Treatment of Igfbp2$^{-/-}$ Mice with Pegylated Heparin-Binding Peptide (PEG-HBD-Peptide).

Igfbp2$^{+/+}$ and Igfbp2$^{-/-}$ mice were administered with PBS or PEG-HBD-peptide (50 μg/day) intraperitoneally 5 times per week from 6 to 9 weeks of age. Dual-energy x-ray absorptiometry was performed before the initiation of treatment. Mice were injected with 20 mg/kg calcein intraperitoneally 7 days and 2 days before sample collection.

Dual-Energy x-Ray Absorptiometry (DXA).

Dual-energy x-ray absorptiometry (DXA) for whole body and femoral areal bone mineral density (aBMD) and body composition exclusive of the head were performed using the PIXImus (GE-Lunar)[10]. The PIXImus was calibrated daily with a mouse phantom provided by the manufacturer.

MicroCT.

Microarchitecture of distal trabecular bone and midshaft cortical bone was analyzed with femurs and vertebrae (L5) by MicroCT (MicroCT40)[10]. Approximately 100 slices were measured just proximal to the distal growth plate, with an isotropic pixel size of 12 μm and slice thickness of 12 μm. Midshaft cortical bone thickness was analysis in a similar fashion using approximately 18 slices obtained at the exact midpoint of the femur.

Bone Histomorphometry.

In vivo histomorphometry differences were analyzed between Igfbp2$^{-/-}$ mice treated with PBS or PEG-HBD-peptide at 9 weeks of age, Mice were injected with 20 mg/kg calcein intraperitoneally 7 days and 2 days before sample collection. Femurs were analyzed as described previously[10].

Femoral Biomechanics.

Femoral biomechanical properties were compared by three-point bending between Igfbp2$^{-/-}$ mice treated with PBS or PEG-HBD-peptide at 9 weeks of age. Load was applied at a constant rate (0.05 mm/sec) until failure. Failure load (newtons), bending stiffness (newtons per millimeter), and work-to-failure (newton-millimeters) from the load-displacement curve were measured and the apparent elastic modulus (megapascal) and ultimate strength (gigapascal) were measured using the relevant midfemoral cross-sectional geometry measured from μCT.

Statistical Analysis.

All data are expressed as the mean±Standard Error of the Mean (SEM). Results were analyzed for statistically significant differences using Student's t-test or ANOVA followed by Bonferroni multiple comparison post hoc test. The glucose tolerance test was analyzed using repeat measures ANOVA. Statistical significance was set at $p<0.05$.

The Heparin-Binding Domain of IGFBP-2 Stimulates In Vitro Osteoblastogenesis.

Figure 1B:
Figure 1C:
Figure 1C:
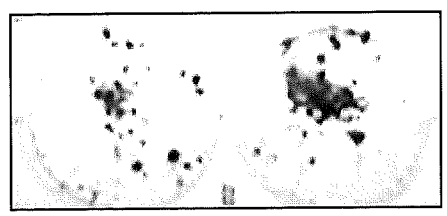
Figure 1D:
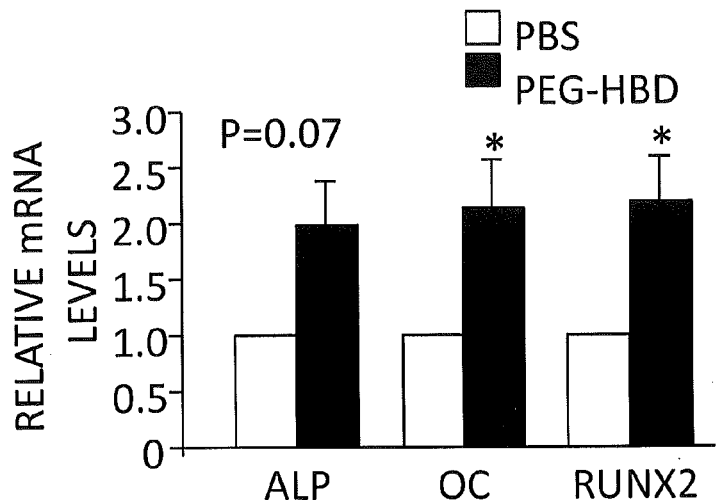
Figure 7:
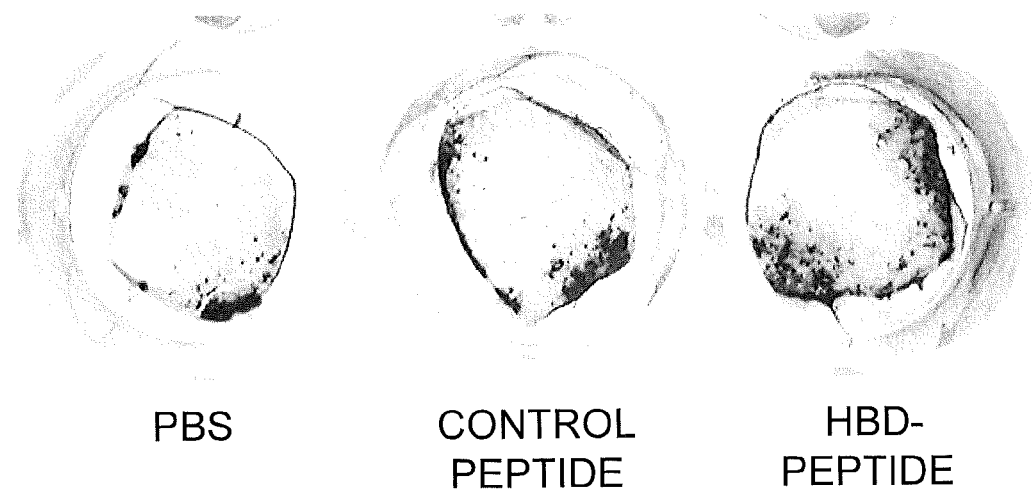
FIG. 7. Control peptide for heparin-binding domain peptide does not have any anabolic effects on in vitro osteoblastogenesis. Igfbp2$^{-/-}$ calvarial osteoblasts (COBs) were cultured with osteogenic media with PBS, control peptide (2 µg/ml) or heparin binding domain peptide (HBD-peptide) (2 µg/ml). Osteoblastogenesis was evaluated by Alizarin Red staining.
Figure 8A:
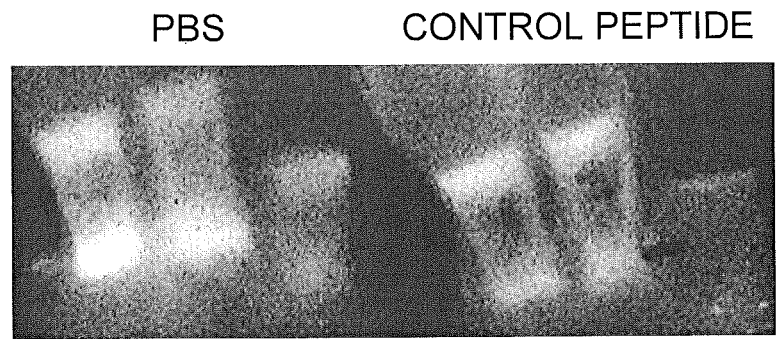
FIG. 8. Control peptide for heparin binding domain peptide does not have any anabolic effects on metacarpals ex vivo. Metacarpals were collected from day 1 male Igfbp2$^{+/+}$ mouse, and cultured in DMEM (1 g/L of glucose) containing 1 mM β-glycerophosphate and 50 µg/ml ascorbic acid. Either PBS or control peptide (2 µg/ml) was added to the media. At day 10, bones were treated with 500 ng/ml of calcein for two hours. Calcein incorporated area was visualized (a) and longitudinal length of incorporated area was quantified (b). Metacarpals were fixed with 4% PFA and subjected to Alcian blue and von Kossa double staining (c). Length and width of metacarpals were quantified (d). Values were expressed as the mean±SEM (n=3). Statistical significance was analyzed by Student's t-test. ns; not significant.
Figure 8B:
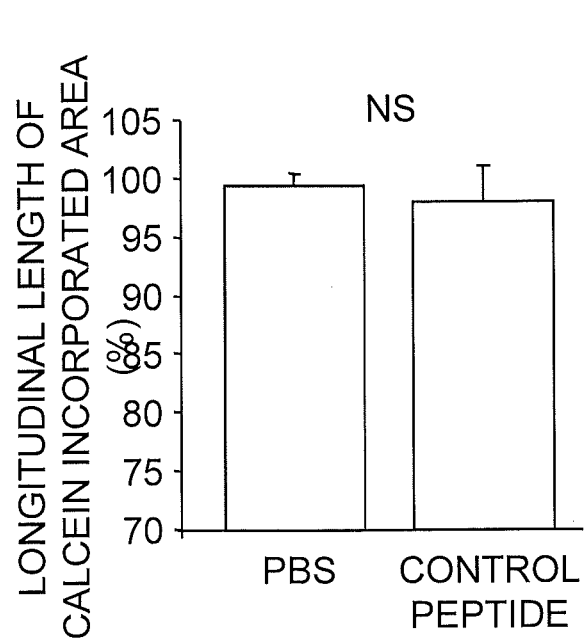
Figure 8C:
Figure 8D:
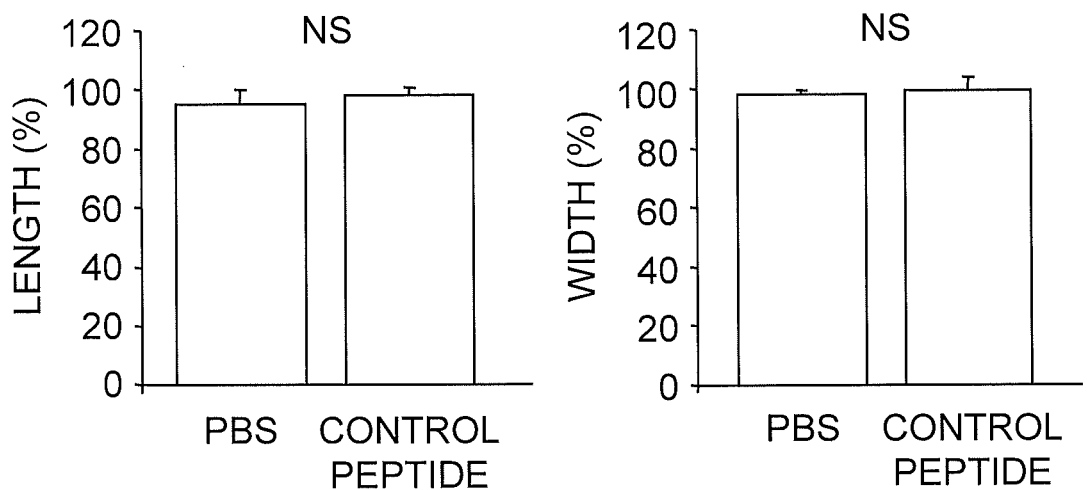

It has been reported previously that Igfbp2$^{-/-}$ mice exhibited an osteopenic phenotype with low bone formation and impaired osteoblastogenesis in bone marrow stromal cells (BMSCs) from Igfbp2$^{-/-}$ mice compared to wild-type cells (FIG. 1a)[10]. Consistent with this, Igfbp2-deficient calvarial osteoblasts (COBs) exhibited impaired alkaline phosphatase (ALP) activity during osteoblastogenesis compared to wild-type cells (FIG. 1b). To investigate whether the heparin-binding domain (HBD) of IGFBP-2 has an anabolic effect on the skeleton, a small molecule (the HBD-peptide), which contains the HBD of IGFBP-2, was generated and tested for its effect on osteoblastogenesis in vitro. To confirm that the effect of HBD-peptide was specific, a control peptide was also made and analyzed for its effect on osteogenesis. The control peptide did not enhance mineralization of Igfbp2$^{-/-}$ COBs compared to PBS-treated cells, whereas the HBD-peptide was fully active (FIG. 7). To prolong the half-life of the small molecule such that it was feasible to undertake in vivo studies, pegylation of the HBD-peptide was performed (PEG-HBD). Igfbp2$^{-/-}$ COBs and BMSCs were cultured in osteogenic media (i.e., ascorbic acid and β-glycerol phosphate) in the presence of the PEG-HBD. PEG-HBD strongly enhanced osteogenesis of COBs and BMSCs as measured by alkaline phosphatase and Alizarin Red staining (FIG. 1c). Consistent with this, ALP, Runx2 and osteocalcin (OC) expression were enhanced in BMSCs treated with PEG-HBD compared to control treated cells (FIG. 1d).

The Heparin-Binding Domain of IGFBP-2 Stimulates Periosteal Expansion of Metacarpals Ex Vivo.

Figure 2A:
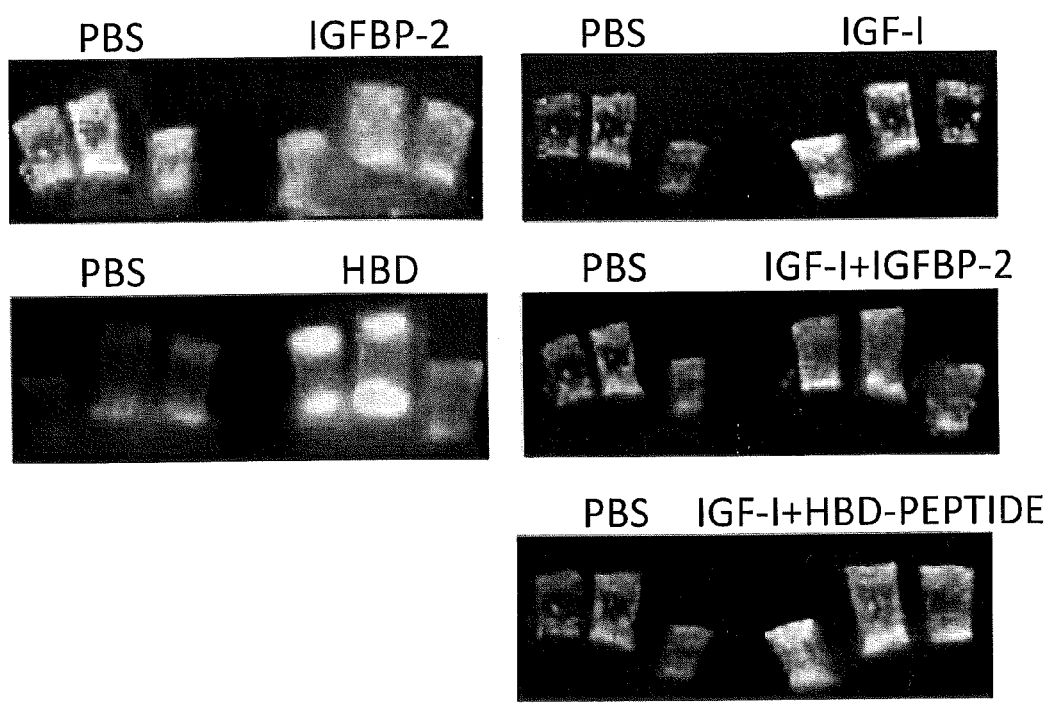
FIG. 2. The heparin binding domain of IGFBP2 enhances periosteal expansion of metacarpals ex vivo. Metacarpals were collected from day 1 male mouse, and treated with osteogenic media with IGFBP2 (200 ng/ml) or the heparin-binding domain peptide (HBD-peptide) (2 µg/ml) in the presence or absence of IGF-1 (20 ng/ml) for 10 days. Bones were labeled with calcein (500 ng/ml) and calcein incorporated area was visualized (a) and longitudinal length of calcein incorporated area was quantified (b). Alcian blue and Von Kossa double staining was performed (c) and length and width of metacarpals were quantified (d). Statistical difference was analyzed by ANOVA followed by Bonferroni post-hoc test. Figures shown represent at least 3 independent experiments. Values are expressed as the mean±SEM (n=3-4). $^a$; <0.05 vs PBS, $^b$; <0.01 vs PBS, $^c$; <0.001 vs PBS, $^d$; <0.01 vs HBD, $^e$; <0.05 vs IGF-I, $^f$; <0.05 vs HBD.
Figure 2B:
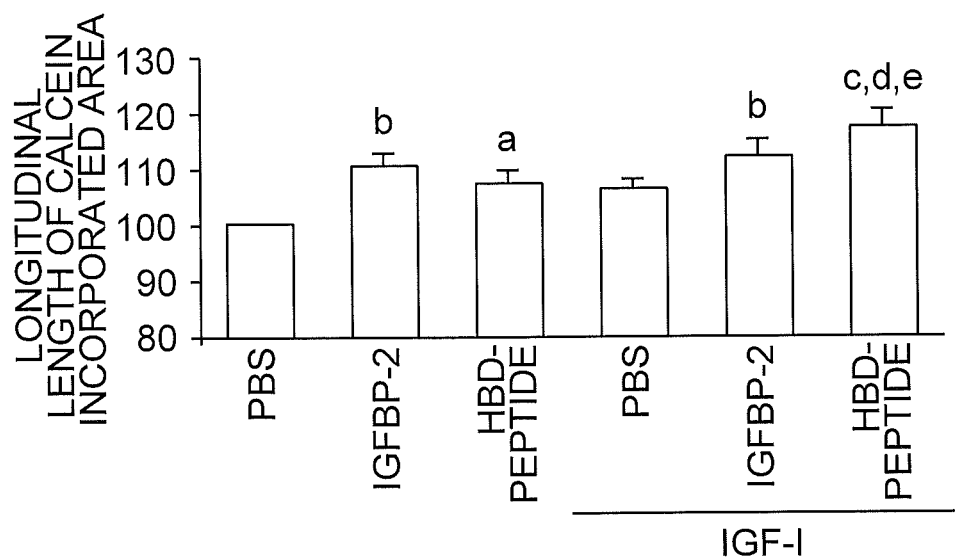
Figure 2C:
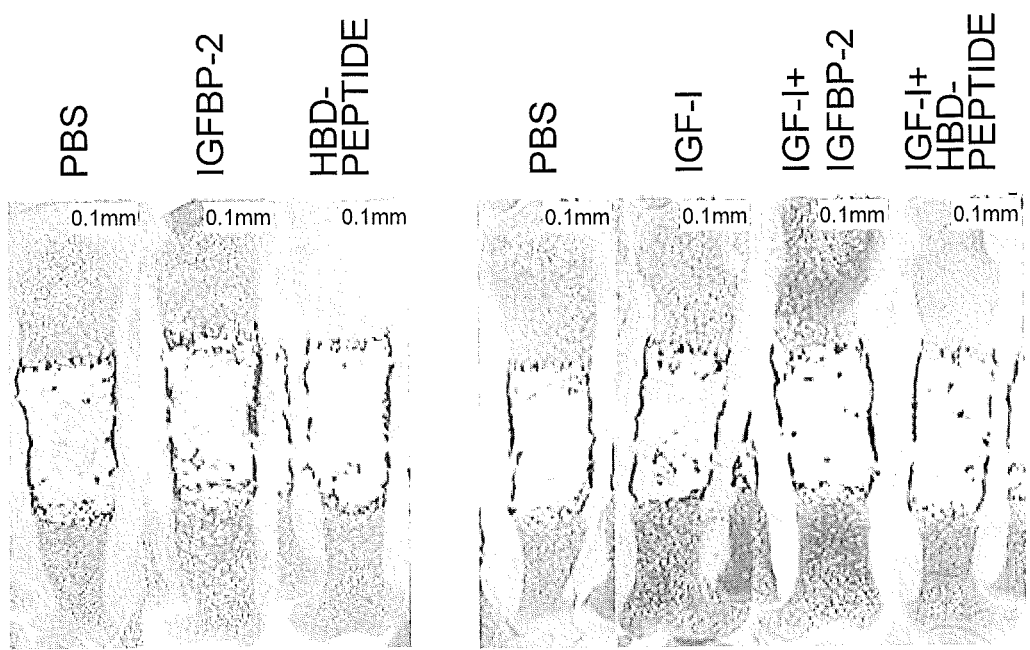
Figure 2D:
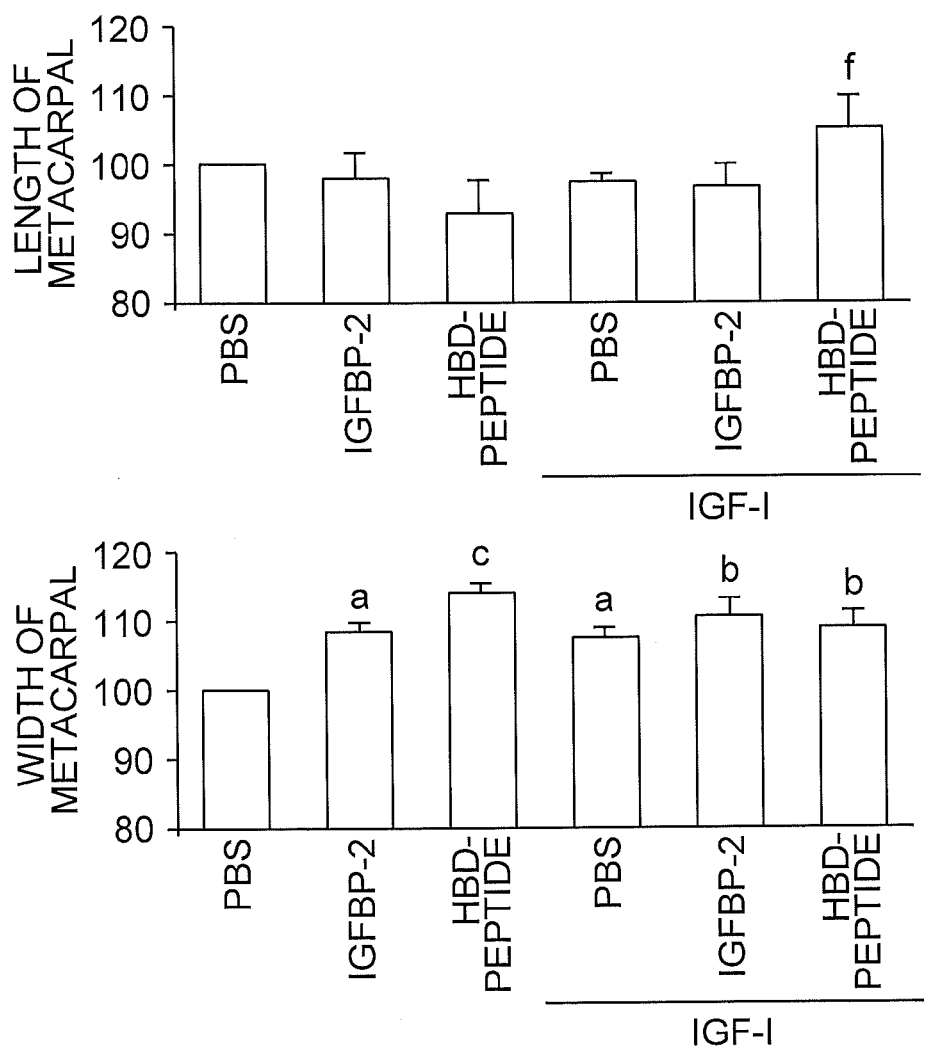

To further understand the anabolic effect of the HBD on the skeleton, metacarpals from 1 day old mouse were collected and incubated with osteogenic media in the absence of fetal calf serum and analyzed for the effects of HBD-peptide on skeletal growth. Bone accrual was evaluated by the longitudinal length of calcein incorporated area as well as width and length of metacarpals. The control peptide had no effect on calcein incorporated area, and length and width of metacarpals was comparable to the metacarpals treated with PBS. Hence PBS was used as the subsequent control for further studies (FIG. 8). As shown in FIG. 2a, IGFBP-2 and HBD-peptide significantly enhanced calcein incorporated area of metacarpals (FIGS. 2a and b). IGF-I also stimulated expansion of calcein incorporated area to a similar extent as IGFBP-2 and HBD-peptide (FIGS. 2a and b). When metacarpal bones were treated with IGF-I together with the HBD-peptide the metacarpals displayed further enhancement of calcein incorporated area. In addition, IGFBP-2 and HBD-peptide also increased the width of metacarpals, implying that IGFBP-2 has an important role in periosteal expansion (FIGS. 2c and d).

The Heparin-Binding Domain of IGFBP-5 does not have an Anabolic Effect on the Skeleton In Vitro and Ex Vivo.

Figure 3A:
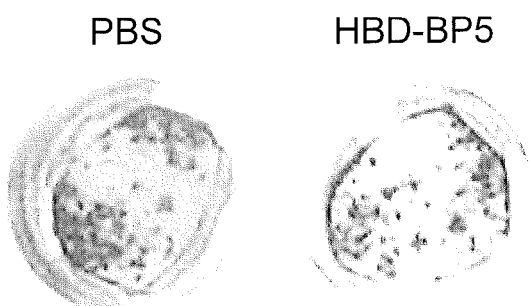
FIG. 3. The heparin binding domain of IGFBP5 does not show any effect on in vitro osteoblastogenesis or periosteal expansion of metacarpals ex vivo. Primary calvarial osteoblasts were collected from male Igfbp2$^{-/-}$ male mouse and treated with osteogenic media with or without the heparin-binding domain of IGFBP-5 (HBD-BP5) (2 µg/ml). Osteoblastogenesis was evaluated by Alizarin Red staining (a). Metacarpals were collected from day 1 male mouse, and treated with osteogenic media with or without HBD-BP5 (2 µg/ml) for 10 days (b and c). Bones were labeled with calcein (500 ng/ml) and calcein incorporated area was visualized (a). Longitudinal length of calcein incorporated area was quantified (b and c). Alcian blue and Von Kossa double staining was performed (d) and length and width of metacarpals were quantified (e). Figures shown represent at least 3 independent experiments. Values are expressed as the mean±SEM. Statistical difference was analyzed by Student's t-test (n=3-4).
Figure 3B:
Figure 3E:
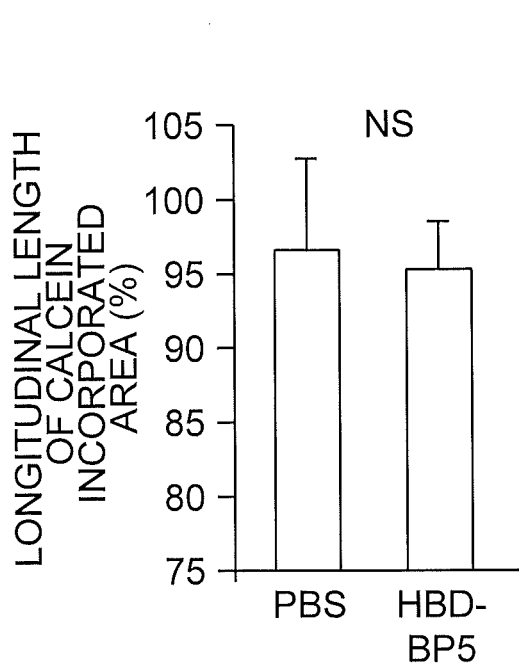
Figure 3E:
Figure 3E:
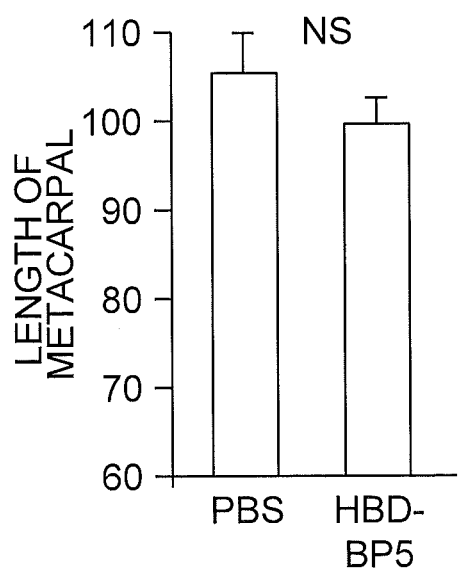
Figure 3E:
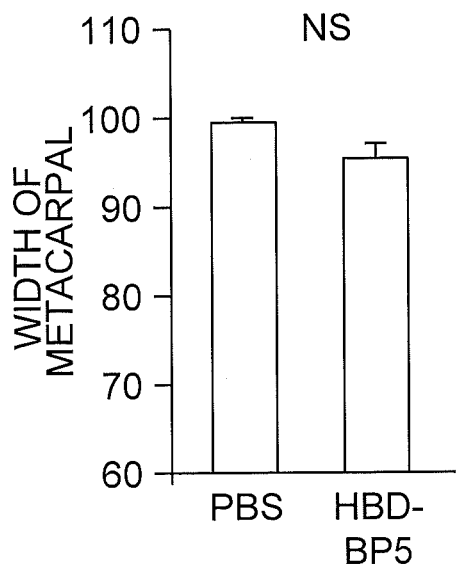

Because other IGFBPs possess HBD regions as well as IGFBP-2, analyses were carried out to determine whether the osteogenic effect of the HBD peptide is specific for this region in IGFBP-2 or whether the HBD domain in other forms of IGFBPs also had this effect. For this purpose a peptide was prepared that contained the HBD region in IGFBP-5 (HBD-BP5) and its effect on osteoblastogenesis was determined. Igfbp2-deficient COBs were cultured in the presence of HBD-BP5 and it was determined that HBD-BP5 did not show any enhancement of mineralization compared to PBS-treated cell (FIG. 3a). Second, metacarpals were collected and treated with osteogenic media with or without HBD-BP5. HBD-BP5 did not have any effect on calcein incorporated area or length and width of metacarpals. These data indicate that the effect of the HBD on skeletal acquisition is likely specific to IGFBP-2.

The Heparin-Binding Domain of IGFBP-2 Rescues the Osteopenic Phenotype of Igfbp2$^{-/-}$ Mice In Vivo by Improving Skeletal Micro-Architecture.

Figure 4A:
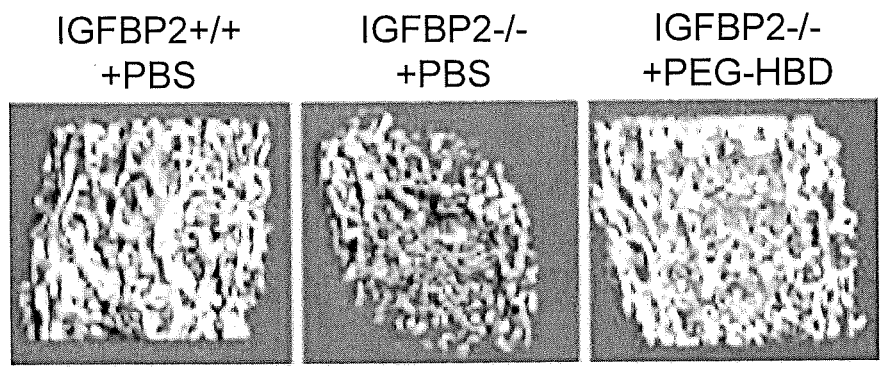
FIG. 4. The heparin-binding domain of IGFBP2 partially rescues osteopenic phenotype of Igfbp2$^{-/-}$ mice. Igfbp2$^{-/-}$ mice were treated with PBS or pegylated heparin-binding domain (PEG-HBD) from 6 to 9 weeks of age. MicroCT image of distal femur (a). Parameters by three-point bending study were shown (b). Osteoblast number/bone perimeter (Nob/BPm), osteoblast surface/bone surface (ObS/BS), osteoclast number/bone parameter (Noc/BPm) and erosion surface/bone surface (ES/BS) were determined by histomorphometry (n=5) (c). Adipocyte number (N.Ad) was counted just proximal to the distal growth plate of femur and normalized by the total area (T.Ar) (n=6) (d). Igfbp2$^{-/-}$ calvarial osteoblasts (COBs) were treated with PBS or PEG-HBD for 24 hours in serum-free media. Expression of Pparg was analyzed by real-time PCR (n=3) (e). Serum levels of Trap5b were analyzed by ELISA (Immunodiagnostics Inc.) (n=6-9) (f). Igfbp2$^{-/-}$ COBs were treated with or without PEG-HBD for 2 hours (g), Igfbp2$^{-/-}$ BMSCs were cultured with osteogenic media with PBS or PEG-HBD for 2 weeks (h). Expression of Opg and Rankl was analyzed by real-time PCR (n=3) (g and h). Figures shown represent at least 3 independent experiments. Values are expressed as the mean±SEM. Statistical difference was analyzed by Student's t-test *; <0.001, **; <0.01, $^†$; <0.05, $^{††}$; <0.06.
Figure 4B:
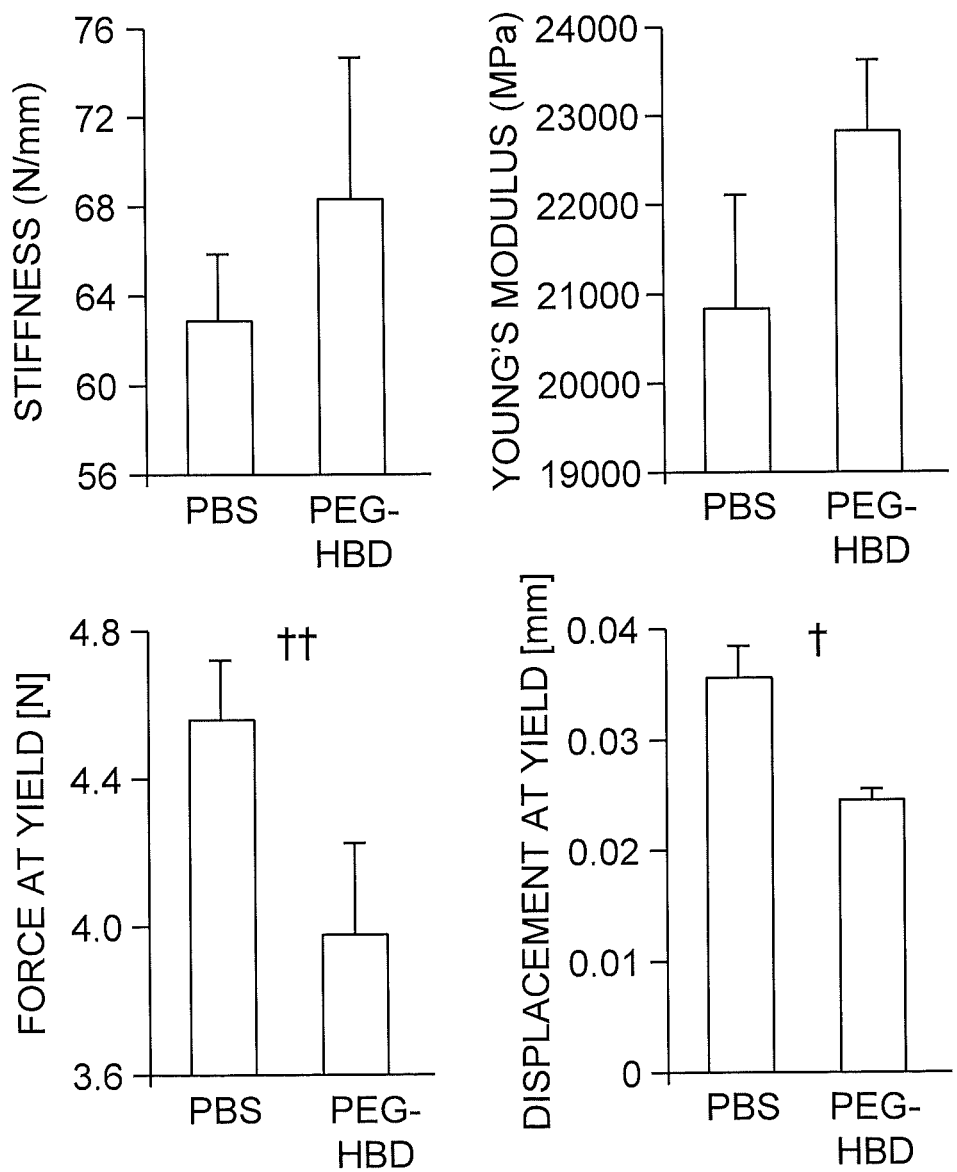

Based on these in vitro and ex vivo observations studies were conducted to determine if the HBD-peptide could rescue the osteopenic phenotype of Igfbp2$^{-/-}$ mice. For this purpose, Igfbp2$^{-/-}$ mice were treated with PBS or PEG-HBD. Based on the half-life analysis of PEG-HBD (data not shown), 50 μg of PEG-HBD were administered 5 times per week for 3 weeks in mice from 6 to 9 weeks of age. Whole-body areal bone mineral density (aBMD) and bone mineral content (aBMC)/body weight (BW) analyzed by DXA were not different before initiation of treatment between Igfbp2$^{-/-}$ mice treated with PBS or PEG-HBD (Table 3). As expected due to normal growth and consolidation, Igfbp2$^{+/+}$ mice treated with PBS showed increased trabecular bone volume by microCT compared to Igfbp2$^{-/-}$ mice treated with PBS. Treatment with the PEG-HBD enhanced whole body aBMD and aBMC/BW in Igfbp2$^{-/-}$ mice (Table 4) although it did not reach statistical significance. On the other hand, microCT analysis revealed an increase in trabecular bone volume both in the distal femur and L5 vertebrae of Igfbp2$^{-/-}$ mice treated with PEG-HBD vs PBS-treated Igfbp2$^{-/-}$ mice. This was accompanied by increased trabecular thickness (FIG. 4a, Table 1, Table 5). Cortical thickness at the midshaft of the femur was not affected by administration of PEG-HBD, but total area analyzed at the level of the femur midshaft was increased in Igfbp2$^{-/-}$ mice treated with PEG-HBD compared to PBS-treated Igfbp2$^{-/-}$ mice. This is consistent with an effect of PEG-HBD on periosteal expansion in a manner similar to what was demonstrated in the ex vivo metacarpal assay (Table 1 and FIG. 2). The skeletal architectural changes were associated with a similar trend in bone strength. In the three point bending studies of the femur, Igfbp2$^{-/-}$ mice treated with PEG-HBD had slightly higher bone stiffness and estimated Young's Modulus compared to PBS treated null mice (FIG. 4b). Furthermore, force at yield and displacement-at-yield were lower in the PEG-HBD treated animals compared to controls (FIG. 4b).

Histomorphometric analysis revealed that osteoblast number per bone perimeter was significantly increased, whereas osteoclast number per bone perimeter exhibited a decrease in Igfbp2$^{-/-}$ mice treated with PEG-HBD vs PBS-treated Igfbp2$^{-/-}$ mice (FIG. 4c, Table 6). Interestingly, the number of bone marrow adipocytes was reduced in Igfbp2$^{-/-}$ mice treated with PEG-HBD, although PEG-HBD did not have a direct effect on whole body adiposity (FIG. 4d, Tables 3 and 4). The increase in osteoblast number of the Igfbp2$^{-/-}$ mice treated with PEG-HBD coincident with the reduction in marrow adipocytes implies that allocation of mesenchymal stem cells may be altered towards the osteogenic lineage in mice treated with PEG-HBD. Consistent with this, Pparg expression was reduced in COBs treated with PEG-HBD (FIG. 4e).

Figure 4F:
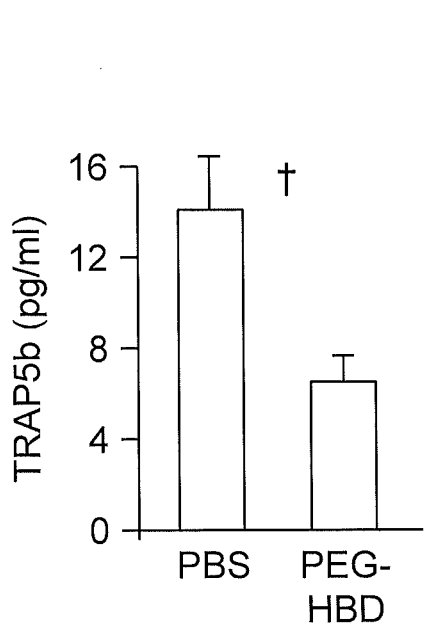
Figure 4G:
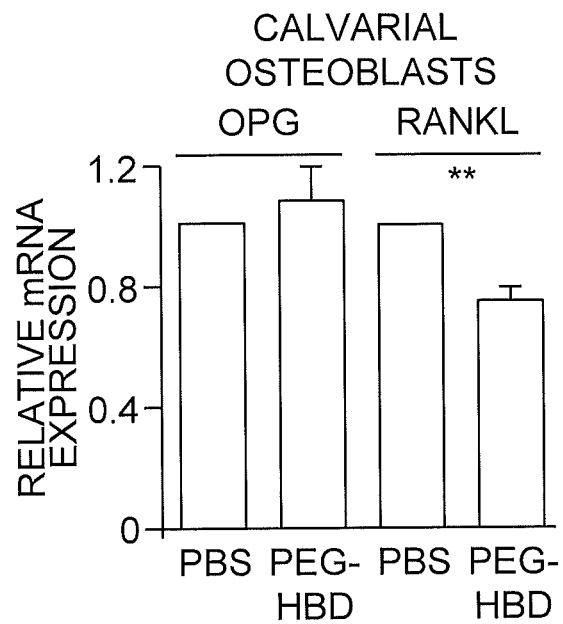
Figure 4H:
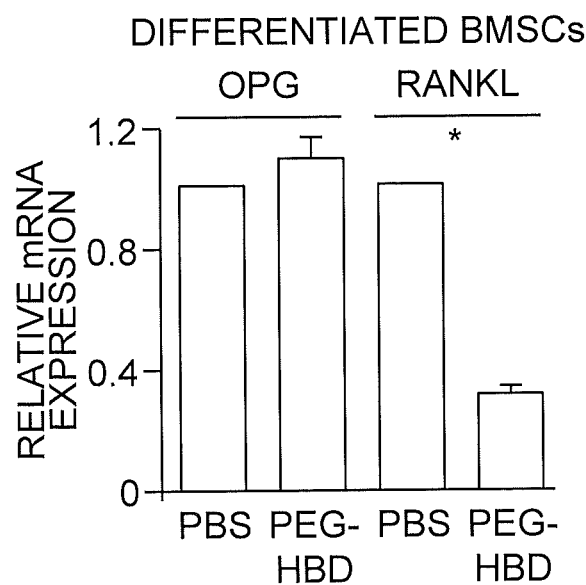

In respect to the reduction in osteoclast number seen on histomorphometry from PEG-HBD treated mice, serum TRAP5b levels were also significantly decreased in Igfbp2$^{-/-}$ mice treated with PEG-HBD (FIG. 4f). To investigate the mechanism whereby PEG-HBD affects osteoclasts, bone marrow stromal cells from Igfbp2$^{-/-}$ mice were cultured and osteoclastogenesis was induced in the presence or absence of the HBD. PEG-HBD did not have a direct effect on osteoclastogenesis (data not shown). Second, Igfbp2$^{-/-}$ COBs and BMSCs were collected and treated with PEG-HBD. PEG-HBD did not affect Opg expression, but it markedly suppressed Rankl expression (FIGS. 4g and h). These data imply that PEG-HBD reduces osteoclastogenesis indirectly through down-regulation of Rankl expression in osteoblasts.

The Heparin-Binding Domain of IGFBP-2 Suppresses PTEN Expression and Stimulates IGF-I/Akt Signaling.

Figure 5A:
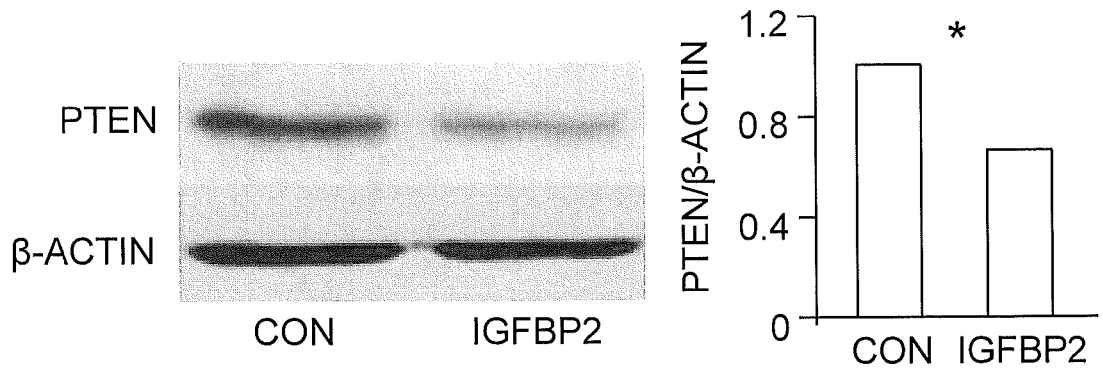
FIG. 5. The heparin-binding domain of IGFBP2 suppresses PTEN expression. a and b, Igfbp2$^{-/-}$ calvarial osteoblasts (COBs) were isolated, and treated with PBS, IGFBP-2 or pegylated heparin-binding domain peptide (PEG-HBD) in MEMα containing 0.1% BSA overnight. Whole cell lysate was collected and expression of PTEN and α-actin was analyzed by Western blot analysis. Expression levels of PTEN were quantified by normalizing to the expression levels of α-actin. c and d. COBs pre-incubated with PBS, IGFBP-2 or PEG-HBD overnight were treated with IGF-I (100 ng/ml) for 15 minutes. Whole cell lysate was collected and expression of pSer473-Akt and Akt was analyzed by Western blot analysis. Expression levels of pSer473-Akt were quantified by normalizing to the expression levels of Akt. Figures shown represent at least 3 independent experiments. Values are expressed as the mean±SEM (n=3-4). Statistical difference was analyzed by Student's t-test. *; <0.001, **; <0.01, $^†$; <0.05.
Figure 5B:
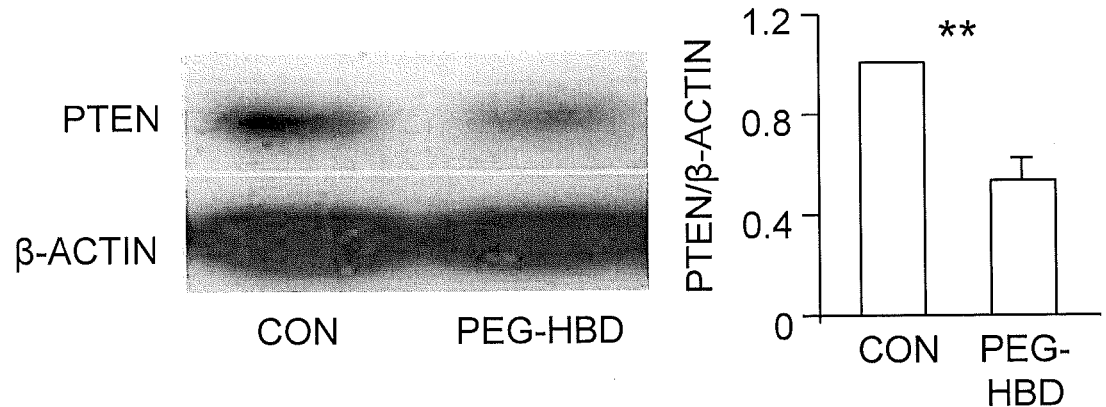
Figure 5C:
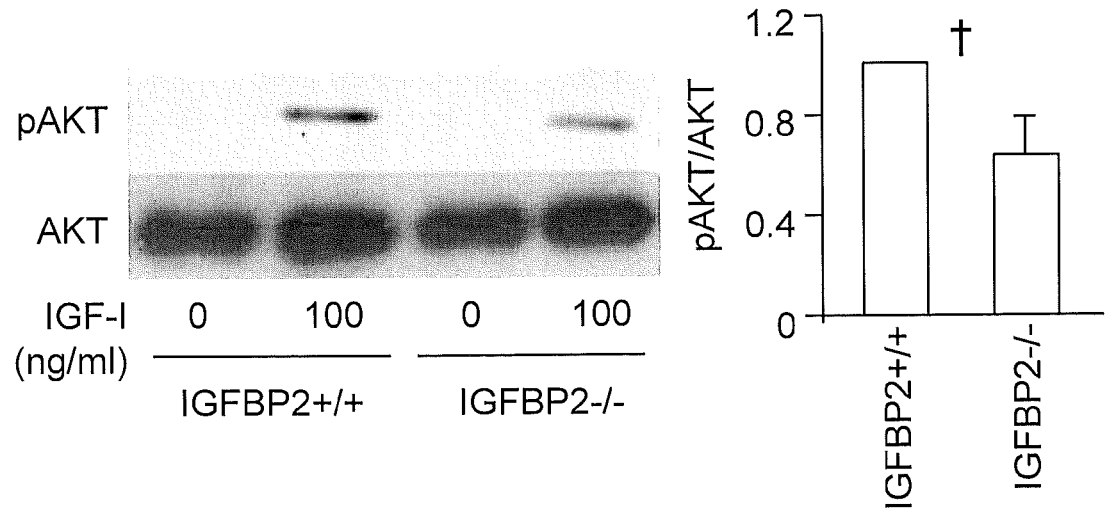
Figure 5D:
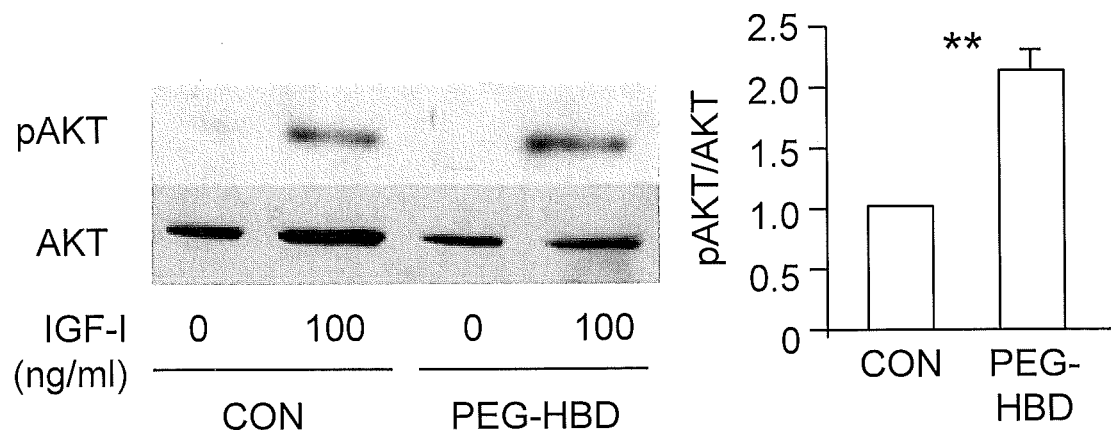
Figure 9A:
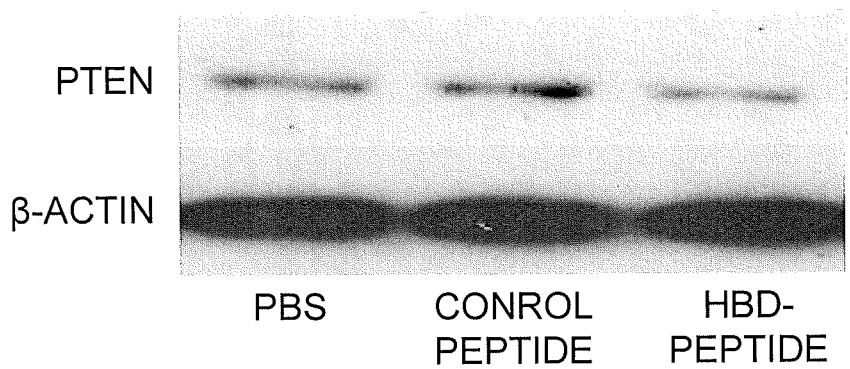
FIG. 9. Control peptide for heparin-binding domain peptide does not suppress PTEN expression in Igfbp2$^{+/+}$ calvarial osteoblasts. Igfbp2$^{+/+}$ calvarial osteoblasts were treated with PBS, control peptide, or heparin-binding domain peptide (HBD-peptide) overnight, and whole cell lysate was collected. PTEN expression was analyzed using western blot analysis (a), and quantitative analysis was performed (b). Values were expressed as the mean±SEM (n=3). Statistical significance was analyzed by ANOVA followed by Bonferroni post-hoc test. $^a$; p<0.01 vs. PBS, $^b$; p<0.01 vs. control peptide.
Figure 9B:
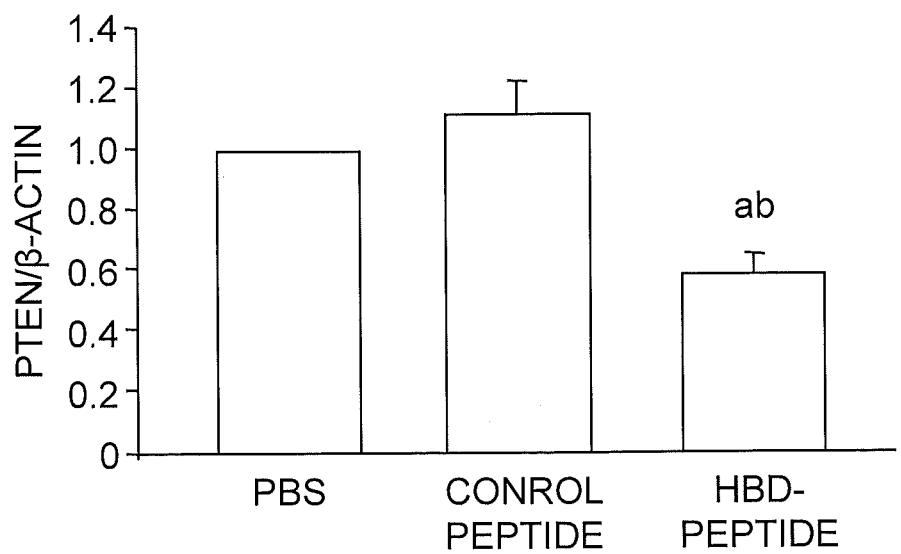

There is evidence of a negative association between IGFBP-2 and PTEN expression in human cancer cells such as glioblastoma and prostate cancer[18-21]. In addition, PTEN expression has beef shown to be enhanced in Igfbp2 deficient osteoblasts[10]. These findings led to the speculation that IGFBP-2 negatively regulates PTEN expression and enhances IGF-I signaling in osteoblasts. First analyses were carried out to determine whether IGFBP-2 suppressed PTEN expression using primary Igfbp2$^{-/-}$ COBs. It was found that full-length IGFBP-2 markedly suppressed PTEN expression in these cells (FIG. 5a). The control peptide had no effect on PTEN expression (FIG. 9), but much like IGFBP-2, PEG-HBD also induced a reduction in PTEN expression (FIG. 5b). Second, analyses were carried out to determine whether the reduction in PTEN expression resulted in enhanced IGF-I/Akt signaling. Western blot analysis for phosphorylation of Akt at serine 473 (pSer473-Akt) revealed that IGF-I stimulated Akt activation was impaired in Igfbp2$^{-/-}$ COBs compared to Igfbp2$^{+/+}$ COBs (FIG. 5c). Furthermore, pSer473-Akt was enhanced in Igfbp2$^{-/-}$ COBs treated with PEG-HBD vs PBS-treated controls (FIG. 5d). These data indicate that IGFBP-2 enhances IGF-I stimulated/Akt activation by suppressing PTEN expression in part through the HBD.

The Heparin-Binding Domain of IGFBP-2 Stimulates IGF-I Induced Cytosolic β-Catenin Accumulation and Ser552 Phosphorylation of β-Catenin.

Figure 6A:
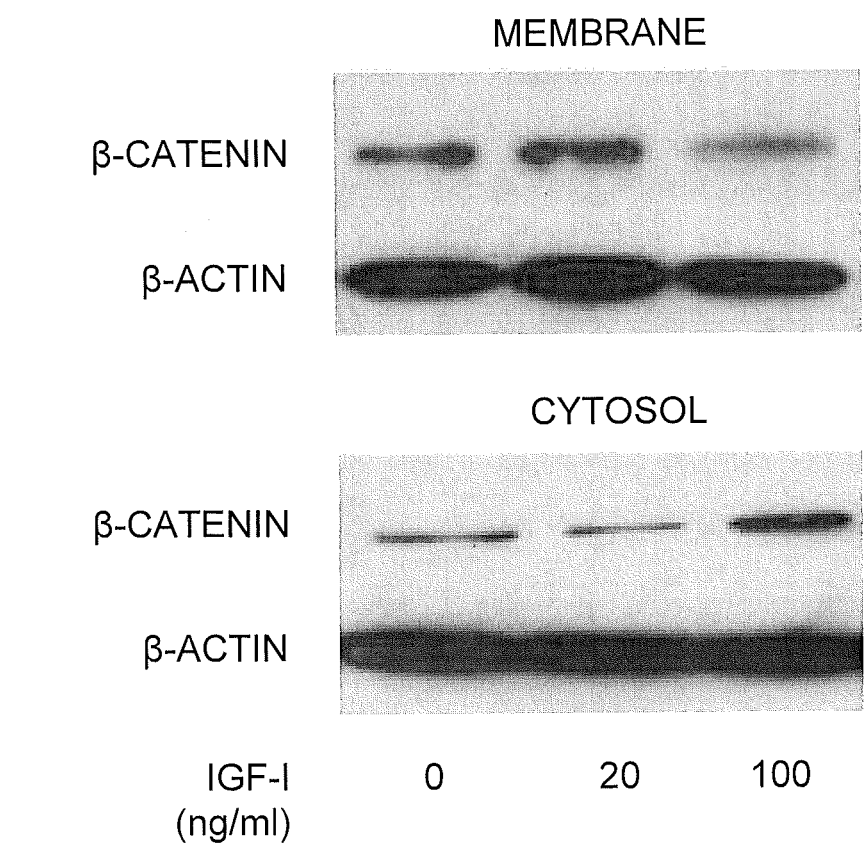
FIG. 6. The heparin-binding domain of IGFBP-2 stimulates cytosolic accumulation and Ser552 phosphorylation of β-catenin by IGF-I. a, MC3T3-E1 cells were serum-starved over-night and treated with IGF-I at the indicated concentration for 6 hours. Expression of β-catenin and α-actin was analyzed by Western blot analysis with membrane and cytosolic fraction. b, Igfbp2$^{-/-}$ calvarial osteoblasts (COBs) were serum-starved over-night with PBS or pegylated heparin-binding domain peptide (PEG-HBD) and then treated with IGF-I (100 ng/ml) for 6 hours. Expression of β-catenin was analyzed by Western blot analysis with cytosolic fraction and quantified by normalizing to α-actin (n=3). c, MC3T3-E1 cells were serum-starved over-night and treated with IGF-I (100 ng/ml) for 15 min. Expression of pSer552-β-catenin, β-catenin, pSer473-Akt, Akt and α-actin was analyzed by Western blot analysis with whole cell lysates. d, Igfbp2$^{-/-}$ COBs were serum-starved over-night with PBS or PEG-HBD and then treated with IGF-I (100 ng/ml) for 15 min. Expression of pSer552-β-catenin was analyzed by Western blot analysis with whole cell lysates and quantified by normalizing to β-catenin (n=3). Figures shown represent at least 3 independent experiments. Values are expressed as the mean±SEM. Statistical difference was analyzed by Student's t-test. *; <0.001, **; <0.01, $^†$; <0.05.
Figure 6B:
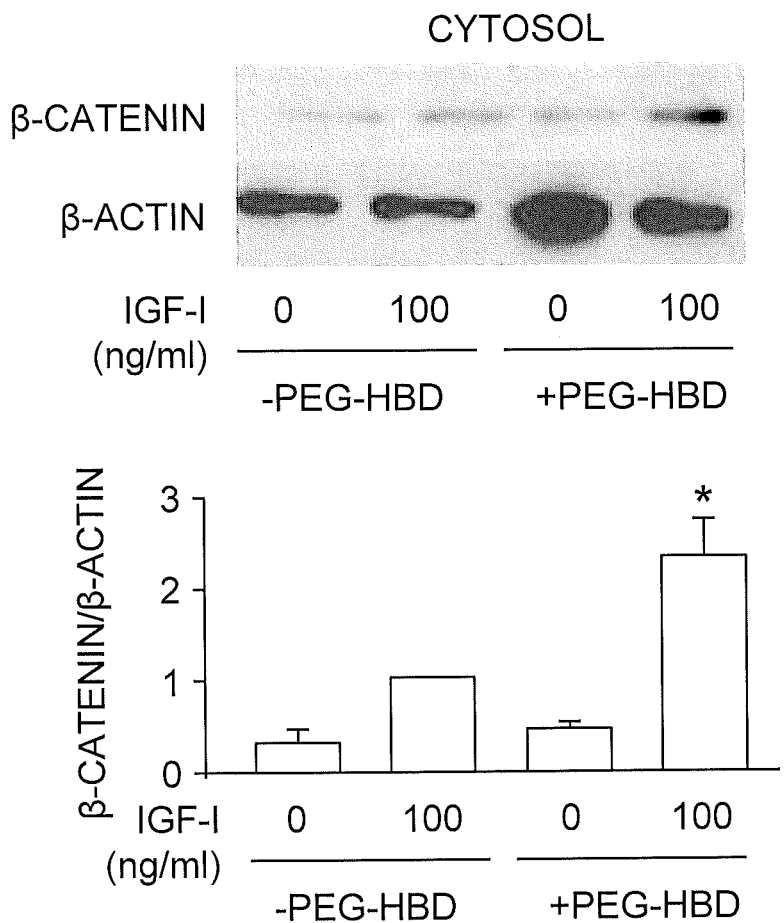
Figure 6C:
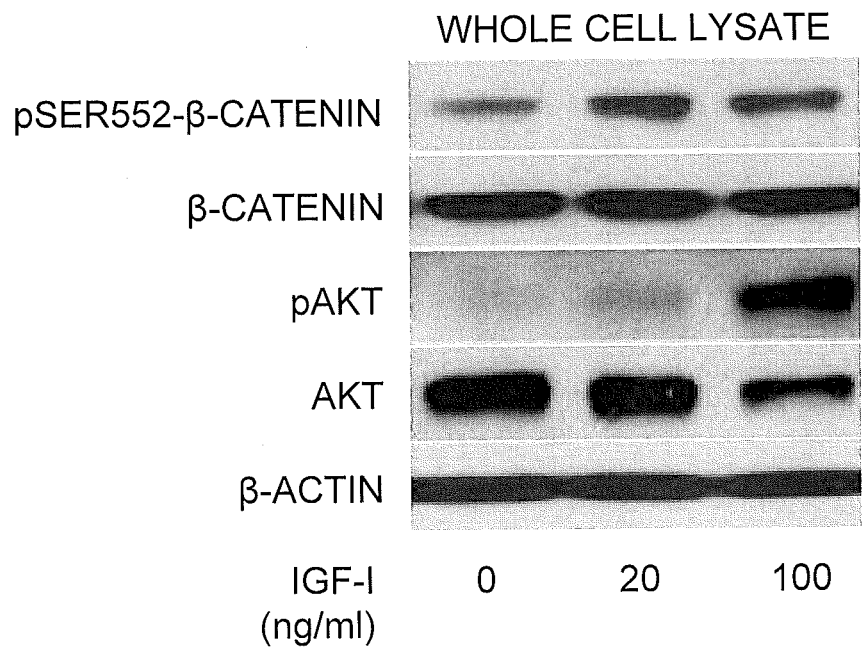
Figure 6D:
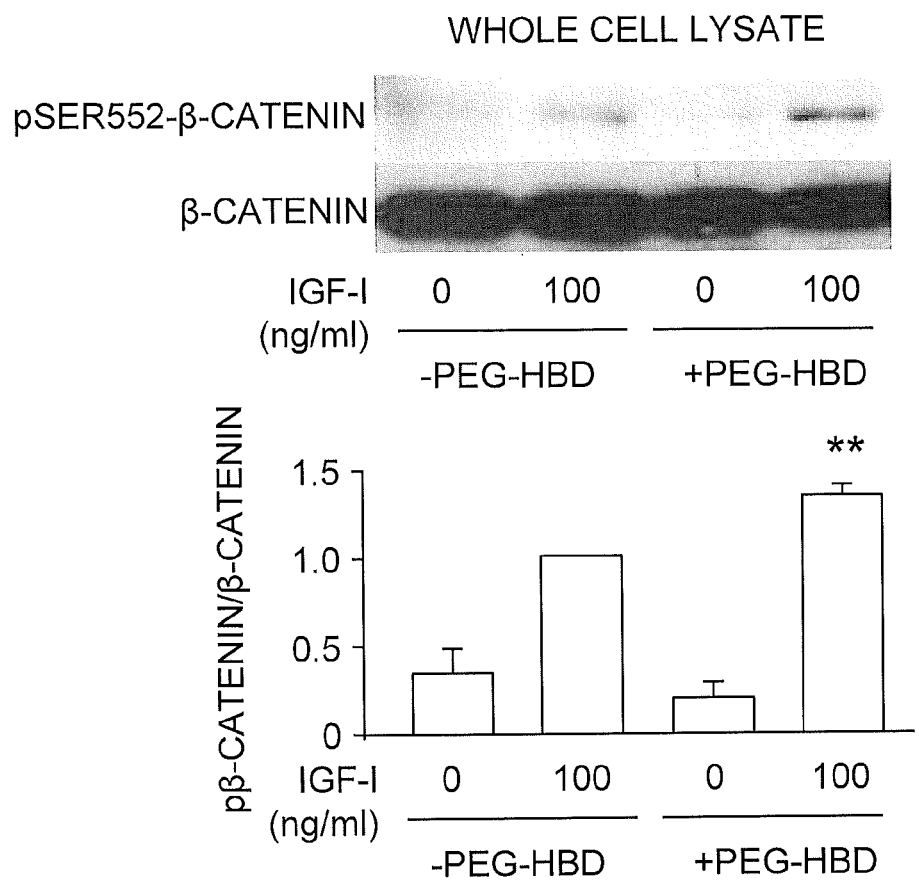

Several lines of evidence demonstrate cross-talk between IGF-I signaling and β-catenin signaling in tumor cell lines[24-27]. Thus, it was hypothesized that IGF-I signaling stimulated β-catenin signaling and that HBD-peptide could enhance β-catenin signaling by suppressing PTEN expression in osteoblastic cells. Analyses were first carried out to determine whether IGF-I affects β-catenin accumulation in the cytosol of osteoblastic cells. Western blot analysis revealed that IGF-I reduced membrane-bound β-catenin expression and enhanced cytosolic accumulation of β-catenin in MC3T3-E1 cells (FIG. 6a). In addition, cytosolic accumulation of β-catenin in response to IGF-I was enhanced in Igfbp2$^{-/-}$ COBs treated with PEG-HBD compared to PBS-treated control cells (FIG. 6b). This suggests that the HBD-peptide is involved in IGF-I/β-catenin signaling possibly by suppressing PTEN expression. Serine 552 (Ser552) phosphorylation of β-catenin, which can be induced by Akt has been shown to be important for dissociation of β-catenin from membrane and re-localization to cytoplasm and nucleus[28-30]. Based on this observation, studies were conducted to determine whether IGF-I stimulated Ser552 phosphorylation in β-catenin and if the HBD-peptide facilitates this response in osteoblastic cells. As shown in FIG. 6c and d, IGF-I stimulated β-catenin phosphorylation on Ser552, and this response was enhanced in cells treated with PEG-HBD. Because activation of β-catenin is important for bone formation, the osteogenic effect of the HBD-peptide might be mediated by IGF-I β-catenin signaling in osteoblasts.

This study provides evidence that the heparin-binding domain of IGFBP-2 may be critical for the anabolic actions of IGFBP-2 on bone. The determination that the HBD suppresses PTEN expression in osteoblasts provides one mechanism by which IGFBP-2 could regulate cell fate. However, sorting the IGF-I dependent and independent activities of intact IGFBP-2 is challenging. IGF-I signaling is a prerequisite for skeletal acquisition and modulation of this signaling pathway results in alterations in skeletal homeostasis[17,34-40]. Therefore, an anabolic effect of the HBD on the skeleton could in part be mediated by enhancement of IGF-1-induced activation of the PI3K/Akt pathway as a result of PTEN suppression. In addition, the increase in osteoblast number in HBD-treated Igfbp2$^{-/-}$ mice could also be due to this mechanistic change since enhanced PI3K/Akt signaling in osteoblasts is involved in cell proliferation. In fact, Liu et al. showed that loss of PTEN in osteoblasts in vivo resulted in very high bone mass and increased osteoblast number[17].

Although the HBD rescued the low osteoblast number in Igfbp2$^{-/-}$ mice, osteoclast number was further diminished by administration of HBD. This observation is consistent with the observed increase in bone mass but suggests that bone turnover is not accelerated by HBD treatment. Indeed, mineral apposition rate and bone formation rate showed minimal changes in Igfbp2$^{-/-}$ mice treated with HBD. In contrast to the HBD, IGF-I signaling has been shown to directly stimulate osteoclastogenesis, and prior data suggest that physiological levels of IGFBP-2 in the skeletal microenvironment are required for osteoclastogenesis[41]. It is possible that IGFBP-2 acts to maintain IGF-I concentrations within the pericellular niche but that the HBD, which lacks the IGF-I binding domain, may play a distinct role by inhibiting bone resorption when supraphysiologic concentrations are administered. Since the HBD does not directly suppress osteoclast differentiation in vitro, the underlying mechanism whereby the HBD decreases bone resorption is likely indirect and due to decreased Rankl expression in osteoblasts. Expression of Rankl is regulated by numerous factors including the Wnt/β-catenin signaling pathway[42]. Glass et al. reported that mice expressing the stabilized form of β-catenin exhibit increased trabecular bone volume with a reduction in osteoclast number primarily caused by an increased Opg/Rankl ratio[43]. Consistent with this, targeted deletion of β-catenin in osteoblasts resulted in low bone mass with increased bone resorption[43]. Thus, stabilization of β-catenin in osteoblasts increases bone mass not only by increasing Wnt mediated activation but also through suppression of bone resorption.

A reduction in PTEN expression has been shown to be associated with increased O-catenin in signaling. Inactivation of GSK3β (glycogen synthase kinase 3) by Akt has been proposed to be the key pathway by which Akt activation enhances β-catenin stabilization, whereas several lines of evidence demonstrate the important role of Ser 552 phosphorylation in β-catenin activation[28-30]. β-catenin is directly phosphorylated by Akt and Ser552 phosphorylation is important for cytosolic and nuclear accumulation of β-catenin, resulting in increased β-catenin transcriptional activity[28]. He et al reported that loss of PTEN resulted in an excess of intestinal stem cells by stimulating β-catenin activity in part through Ser 552 phosphorylation[29]. The current study demonstrated that IGF-I enhanced β-catenin accumulation in cytoplasm and phosphorylated ser552 of β-catenin in osteoblastic cells, and this response was further enhanced by the HBD. Taken together, these lines of evidence suggest that enhanced activation of β-catenin signaling may contribute to both increased bone formation and decreased bone resorption in Igfbp2$^{-/-}$ mice treated with PEG-HBD.

In the PEG-HBD treated Igfbp2$^{-/-}$ mice, osteoblast number was increased and this was accompanied by reduced number of marrow adipocytes. Mesenchymal cell allocation is an important step in regulating bone mass and marrow adiposity. Numerous factors are involved in this process including Wnt/β-catenin signaling and the transcription factor, PPAR-gamma[44]. Activation of Wnt/β-catenin signaling favors osteoblastogenesis over adipogenesis in part by either sequestering PPAR-gamma or suppressing PPAR-gamma transcriptional activity[45-47]. Because HBD enhances β-catenin stability that is induced by IGF-I, the switch of mesenchymal cells towards the osteogenic lineage might explain the increased osteoblasts and reduced adipocytes in bone marrow from Igfbp2$^{-/-}$ mice treated with PEG-HBD.

Nevertheless, the mechanism by which the HBD suppresses PTEN expression has not been defined. One possibility resides in the binding of HBD with the integrin receptor. Maile et al. reported that the heparin-binding domain of vitronectin bound to a cystein loop region of β3 integrin and modulated αVβ3 integrin signaling in smooth muscle cells[48]. Furthermore, Perks et al. reported that PTEN down-regulation by IGFBP-2 might be mediated by an integrin receptor, although they did not demonstrate an interaction between IGFBP-2 and a specific integrin receptor or whether the HBD was involved in this interaction[20].

The presence of an RGD sequence motif in the C-terminus of IGFBP-2 has led to speculation that IGFBP-2 could bind to an integrin, independent of its IGF-binding[3]. Schutt et al. reported that IGFBP-2 binding to the cell surface was mediated through α5β1 integrin, and blocked by RGD-containing peptide in Ewing sarcoma and breast cancer cell lines[49]. Wang et al. also showed that IGFBP-2 interacted with α5 integrin through an RGD motif in a human glioblastoma cell line[50]. In contrast to these reports, Russo et al. and Pereira et al. independently reported that IGFBP-2 binding to extracellular matrix was independent of RGD sequences in neuroblastoma cells and breast cancer cells. In addition, Hoeflich et al. showed that the RGD motif is not involved in IGFBP-2 binding to plasma membrane in multiple organs[51]. Thus, the functional role of the RGD motif in Igfbp2$^{-/-}$ mice remains controversial and further studies are needed.

Results using a supraphysiologic concentration of the HBD cannot be used to reach a definitive conclusion regarding the role of physiologic concentrations of IGFBP-2 in bone acquisition. However, it does suggest that this binding protein has unique properties that might explain the high circulating levels of IGFBP-2 during periods of rapid growth such as the first year of life and during puberty. In summary, these studies show that the HBD in IGFBP-2 has an anabolic effect on the skeleton and this effect is partially mediated by the suppression of PTEN expression and involves activation of β-catenin signaling. These lines of evidence provide new insights regarding the physiologic role of IGFBP-2 in bone and suggest that a small molecule such as the HBD-peptide could have potential as a pharmacological intervention for the treatment of osteoporosis.

REFERENCES FOR EXAMPLE 8

1. Hwa, V., Oh, Y. & Rosenfeld, R. G. The insulin-like growth factor-binding protein (IGFBP) superfamily. *Endocr Rev* 20, 761-87 (1999).
2. Jones, J. I. & Clemmons, D. R. Insulin-like growth factors and their binding proteins: biological actions. *Endocr Rev* 16, 3-34 (1995).
3. Firth, S. M. & Baxter, R. C. Cellular actions of the insulin-like growth factor binding proteins. *Endocr Rev* 23, 824-54 (2002).
4. Hu, D. et al. Serum insulin-like growth factor-1 binding proteins 1 and 2 and mortality in older adults: the Health, Aging, and Body Composition Study. *J Am Geriatr Soc* 57, 1213-8 (2009).
5. Hedbacker, K. et al. Antidiabetic effects of IGFBP2, a leptin-regulated gene. *Cell Metab* 11, 11-22.
6. Wheatcroft, S. B. et al. IGF-binding protein-2 protects against the development of obesity and insulin resistance. *Diabetes* 56, 285-94 (2007).
7. Hoeflich, A. et al. Growth inhibition in giant growth hormone transgenic mice by overexpression of insulin-like growth factor-binding protein-2. *Endocrinology* 142, 1889-98 (2001).
8. Conover, C. A. et al. Subcutaneous administration of insulin-like growth factor (IGF)-II/IGF binding protein-2 complex stimulates bone formation and prevents loss of bone mineral density in a rat model of disuse osteoporosis. *Growth Horm IGF Res* 12, 178-83 (2002).
9. Khosla, S. et al. Insulin-like growth factor system abnormalities in hepatitis C-associated osteosclerosis. Potential insights into increasing bone mass in adults. *J Clin Invest* 101, 2165-73 (1998).
10. DeMambro, V. E. et al. Gender-specific changes in bone turnover and skeletal architecture in igfbp-2-null mice. *Endocrinology* 149, 2051-61 (2008).
11. Arai, T., Busby, W., Jr. & Clemmons, D. R. Binding of insulin-like growth factor (IGF) I or II to IGF-binding protein-2 enables it to bind to heparin and extracellular matrix. *Endocrinology* 137, 4571-5 (1996).
12. Russo, V. C., Bach, L. A., Fosang, A. J., Baker, N. L. & Werther, G. A. Insulin-like growth factor binding protein-2 binds to cell surface proteoglycans in the rat brain olfactory bulb. *Endocrinology* 138, 4858-67 (1997).
13. Russo, V. C., Rekaris, G., Baker, N. L., Bach, L. A. & Werther, G. A. Basic fibroblast growth factor induces proteolysis of secreted and cell membrane-associated insulin-like growth factor binding protein-2 in human neuroblastoma cells. *Endocrinology* 140, 3082-90 (1999).
14. Russo, V. C. et al. Insulin-like growth factor binding protein-2 binding to extracellular matrix plays a critical role in neuroblastoma cell proliferation, migration, and invasion. *Endocrinology* 146, 4445-55 (2005).
15. Duan, C., Ding, J., Li, Q., Tsai, W. & Pozios, K. Insulin-like growth factor binding protein 2 is a growth inhibitory protein conserved in zebrafish. *Proc Natl Acad Sci USA* 96, 15274-9 (1999).
16. Kawai, M. & Rosen, C. J. Insulin-like growth factor-I and bone: lessons from mice and men. *Pediatr Nephrol* 24, 1277-85 (2009).
17. Liu, X. et al. Lifelong accumulation of bone in mice lacking Pten in osteoblasts. *Proc Natl Acad Sci USA* 104, 2259-64 (2007).
18, Cohen, P. et al. Elevated levels of insulin-like growth factor-binding protein-2 in the serum of prostate cancer patients. *J Clin Endocrinol Metab* 76, 1031-5 (1993).
19. Mehrian-Shai, R. et al. Insulin growth factor-binding protein 2 is a candidate biomarker for PTEN status and PI3K/Akt pathway activation in glioblastoma and prostate cancer. *Proc Natl Acad Sci USA* 104, 5563-8 (2007).

20. Perks, C. M., Vernon, E. G., Rosendahl, A. H., Tonge, D. & Holly, J. M. IGF-II and IGFBP-2 differentially regulate PTEN in human breast cancer cells. *Oncogene* 26, 5966-72 (2007).
21. Levitt, R. J., Georgescu, M. M. & Pollak, M. PTEN-induction in U251 glioma cells decreases the expression of insulin-like growth factor binding protein-2. *Biochem Biophys Res Commun* 336, 1056-61 (2005).
22. Sakata, T. et al. Skeletal unloading induces resistance to insulin-like growth factor-I (IGF-I) by inhibiting activation of the IGF-I signaling pathways. *J Bone Miner Res* 19, 436-46 (2004).
23. Shoba, L. N. & Lee, J. C. Inhibition of phosphatidylinositol 3-kinase and p70S6 kinase blocks osteogenic protein-1 induction of alkaline phosphatase activity in fetal rat calvaria cells. *J Cell Biochem* 88, 1247-55 (2003).
24. Jin, T., George Fantus, I. & Sun, J. Wnt and beyond Wnt: multiple mechanisms control the transcriptional property of beta-catenin. *Cell Signal* 20, 1697-704 (2008).
25. Desbois-Mouthon, C. et al. Insulin and IGF-1 stimulate the beta-catenin pathway through two signalling cascades involving GSK-3beta inhibition and Ras activation. *Oncogene* 20, 252-9 (2001).
26. Playford, M. P., Bicknell, D., Bodmer, W. F. & Macaulay, V. M. Insulin-like growth factor 1 regulates the location, stability, and transcriptional activity of beta-catenin. *Proc Natl Acad Sci USA* 97, 12103-8 (2000).
27. Amin, S. et al. High serum IGFBP-2 is predictive of increased bone turnover in aging men and women. *J Bone Miner Res* 22, 799-807 (2007).
28. Fang, D. et al. Phosphorylation of beta-catenin by AKT promotes beta-catenin transcriptional activity. *J Biol Chem* 282, 11221-9 (2007).
29. He, X. C. et al. PTEN-deficient intestinal stem cells initiate intestinal polyposis. *Nat Genet.* 39, 189-98 (2007).
30. Taurin, S., Sandbo, N., Qin, Y., Browning, D. & Dulin, N. O. Phosphorylation of beta-catenin by cyclic AMP-dependent protein kinase. *J Biol Chem* 281, 9971-6 (2006).
31. Glass, D. A., 2nd & Karsenty, G. Molecular bases of the regulation of bone remodeling by the canonical Wnt signaling pathway. *Curr Top Dev Biol* 73, 43-84 (2006).
32. Eckstein, F. et al. Insulin-like growth factor-binding protein-2 (IGFBP-2) overexpression negatively regulates bone size and mass, but not density, in the absence and presence of growth hormone/IGF-I excess in transgenic mice. *Anat Embryol (Berl)* 206, 139-48 (2002).
33. Palermo, C. et al. Potentiating role of IGFBP-2 on IGF-II-stimulated alkaline phosphatase activity in differentiating osteoblasts. *Am J Physiol Endocrinol Metab* 286, E648-57 (2004).
34. Fujita, T. et al. Runx2 induces osteoblast and chondrocyte differentiation and enhances their migration by coupling with PI3K-Akt signaling. *J Cell Biol* 166, 85-95 (2004).
35. Peng, X. D. et al. Dwarfism, impaired skin development, skeletal muscle atrophy, delayed bone development, and impeded adipogenesis in mice lacking Akt1 and Akt2. *Genes Dev* 17, 1352-65 (2003).
36. Liu, J. P., Baker, J., Perkins, A. S., Robertson, E. J. & Efstratiadis, A. Mice carrying null mutations of the genes encoding insulin-like growth factor I (Igf-1) and type 1 IGF receptor (Igf1r). *Cell* 75, 59-72 (1993).
37. Yakar, S. et al. Circulating levels of IGF-1 directly regulate bone growth and density. *J Clin Invest* 110, 771-81 (2002).
38. Zhang, M. et al. Osteoblast-specific knockout of the insulin-like growth factor (IGF) receptor gene reveals an essential role of IGF signaling in bone matrix mineralization. *J Biol Chem* 277, 44005-12 (2002).
39. Zhao, G, et al. Targeted overexpression of insulin-like growth factor I to osteoblasts of transgenic mice: increased trabecular bone volume without increased osteoblast proliferation. *Endocrinology* 141, 2674-82 (2000).
40. Mukherjee, A. & Rotwein, P. Akt promotes BMP2-mediated osteoblast differentiation and bone development. *J Cell Sci* 122, 716-26 (2009).
41. Wang, Y. et al. Role of IGF-I signaling in regulating osteoclastogenesis. *J Bone Miner Res* 21, 1350-8 (2006).
42. Kearns, A. E., Khosla, S. & Kostenuik, P. J. Receptor activator of nuclear factor kappaB ligand and osteoprotegerin regulation of bone remodeling in health and disease. *Endocr Rev* 29, 155-92 (2008).
43. Glass, D. A., 2nd et al. Canonical Wnt signaling in differentiated osteoblasts controls osteoclast differentiation. *Dev Cell* 8, 751-64 (2005).
44. Gesta, S., Tseng, Y. H. & Kahn, C. R. Developmental origin of fat: tracking obesity to its source. *Cell* 131, 242-56 (2007).
45. Liu, J., Wang, H., Zuo, Y. & Farmer, S. R. Functional interaction between peroxisome proliferator-activated receptor gamma and beta-catenin. *Mol Cell Biol* 26, 5827-37 (2006).
46. Bennett, C. N. et al. Regulation of osteoblastogenesis and bone mass by Wnt10b. *Proc Natl Acad Sci USA* 102, 3324-9 (2005).
47. Ross, S. E. et al. Inhibition of adipogenesis by Wnt signaling. *Science* 289, 950-3 (2000).
48. Maile, L. A. et al. Modulation of integrin antagonist signaling by ligand binding of the heparin-binding domain of vitronectin to the alphaVbeta3 integrin. *J Cell Biochem* 105, 437-46 (2008).
49. Schutt, B. S., Langkamp, M., Rauschnabel, U., Ranke, M. B. & Elmlinger, M. W. Integrin-mediated action of insulin-like growth factor binding protein-2 in tumor cells. *J Mol Endocrinol* 32, 859-68 (2004).
50. Wang, G. K., Hu, L., Fuller, G. N. & Zhang, W. An interaction between insulin-like growth factor-binding protein 2 (IGFBP2) and integrin alpha5 is essential for IGFBP2-induced cell mobility. *J Biol Chem* 281, 14085-91 (2006).
51. Hoeflich, A. et al. Mutation of the RGD sequence does not affect plasma membrane association and growth inhibitory effects of elevated IGFBP-2 in vivo. *FEBS Lett* 523, 63-7 (2002).
52. Wood, T. L., Rogler, L. E., Czick, M. E., Schuller, A. G. & Pintar, J. E. Selective alterations in organ sizes in mice with a targeted disruption of the insulin-like growth factor binding protein-2 gene. *Mol Endocrinol* 14, 1472-82 (2000).
53. Rosen, C. J. et al. Congenic mice with low serum IGF-I have increased body fat, reduced bone mineral density, and an altered osteoblast differentiation program. *Bone* 35, 1046-58 (2004).
54. Mukherjee, A. & Rotwein, P. Insulin-like growth factor-binding protein-5 inhibits osteoblast differentiation and skeletal growth by blocking insulin-like growth factor actions. *Mol Endocrinol* 22, 1238-50 (2008).
55. Kawai, M. et al. Growth hormone stimulates adipogenesis of 3T3-L1 cells through activation of the Stat5A/5B-PPARgamma pathway. *J Mol Endocrinol* 38, 19-34 (2007).

Example 9

Efficacy of the Peptide in Inhibiting Fat Accumulation

A variety of data in the literature support that IGFBP-2 inhibits fat accumulation. These data include studies in which IGFBP-2 was overexpressed in mice; that is transgenic mice that produced excessive IGFBP-2 were created. These animals had decreased fat mass. Importantly when they were fed a high fat diet which normally induces glucose intolerance, they maintained normal glucose tolerance compared to control mice that were fed the same high fat diet and developed hyperglycemia. This suggests that IGFBP-2 protects against insulin resistance. In contrast the mice in which the IGFBP-2 gene was deleted had the opposite phenotype; that is they were significantly fatter than control mice. After 24 weeks the IGFBP-2 knockout mice weighed 37±1.5 gm whereas control animals weighed 32±1.3 gm. After 52 weeks this difference was maintained. This is a highly significant difference in total body weight. More importantly when fat mass was analyzed by DEXA scanning almost the entire difference in body weight was due to a difference in fat mass. At 26 weeks the percent body fat in the control mice was 16.1±1.4% fat whereas in the knockout mice it was 24.2±1.1%. Again this is a highly significant difference and indicates that much of the difference in weight was due to a difference in fat. Glucose tolerance testing showed that the IGFBP-2 gene deletion mice had glucose intolerance and were less sensitive to the administration of insulin. This indicates that the increased fat mass caused increased resistance to the hormone insulin. Blood insulin levels were higher in the IGFBP-2 knockout mice showing they had insulin resistance which resulted in high serum insulin concentrations. This has been shown by others to be an important risk factor for cardiovascular disease.

Further experiments have been carried out in which the knockout mice and control animals have been administered the mouse homologue of the heparin binding peptide. The peptide was administered to 8 animals in each group. The 6 week treatment data are provided in Table 2. The knockout animals weighed 30.4±1.5 gm whereas the control animals weighed 25.2±1.1 gm. The knockout animals that received the active peptide weighed 24.9±1.3 gm. This clearly indicated that administration of peptide which was given at a dose of 50 mcg administered intraperitoneally three days per week was effective in preventing weight gain. More importantly when absolute fat mass was analyzed by MRI, highly significant differences were also present. The knockout mice had 6.21±0.76 grams of fat. The control mice had 3.82±0.67 grams and the knockout mice administered the heparin binding peptide had 3.67±0.36 grams. Again these are highly significant differences. Glucose tolerance tests were also performed in these animals and showed that the knockout animals have impaired glucose tolerance and this was significantly improved with administration of the peptide and not significantly different from control mice.

Example 10

Global Deletion of IGFBP-2 Disrupts Hematopoiesis and Compromises Bone Marrow Engraftment in Lethally Irradiated Mice Studies were carried out to determine if global deletion of IGFBP2 (BP2) might disrupt steady-state hematopoiesis and interfere with the engraftment of bone marrow donor cells. Peripheral blood and spleen cells from male (M) and female (F) WT and BP2−/− mice were first analyzed by flow cytometry for the major white blood cell (WBC) populations. In peripheral blood, BP2−/−F-mice had significantly lower CD3+ T cells compared to WT-F and BP2−/− M (p=0.02) while BP2−/−M had significantly increased CD3+ T cells (p=0.03), CD19+ B cells (p=0.00), F480+ macrophages (p=0.00), CD11b+ monocytes (p=0.00) and LY6G+ neutrophils (p=0.02) compared to both WT-M and BP2−/−F. Intraperitoneal injection of IGFBP-2 heparin binding domain (HBD) peptide reduced the percentage of macrophages (p=0.01) and neutrophils (p=0.02) in peripheral blood of BP2−/− M compared to PBS injected controls. BP2−/−F splenic CD3+ T cells were increased (p=0.0) and CD19+ B cells were decreased (p=0.05) compared to WT-F, WT-M and BP2−/−M. There was a significant increase in B220+ B cell progenitor cells in the spleens of BP2−/− M compared to WT-M but no difference in the percentages of all other mature WBC populations. Bone marrow transplants into lethally irradiated WT and BP2−/− male recipients were next performed. In non-competitive transplants, the efficiency of donor engraftment was the same for both strains as ≥75% of the repopulating cells in both WT and BP2−/− were of donor origin (Ly5.1+). In competitive repopulation transplants, support donor cells from LY5.1+ mice were mixed with competitor donor cells from either WT or BP2−/− in 2:3 and 1:3 ratios and transplanted into strain specific recipients. At 8 weeks post transplant, WT recipients in which ⅔ of the donor cells were WT (LY5.2+), 75% of bone marrow cells were of WT origin (LY5.2+) while in BP2−/− recipients in which ⅔ of the donor cells were from BP2−/− (LY5.2+) only 56% of bone marrow cells were LY5.2+ at 8 weeks post transplant representing 20% less (p=0.01) engraftment of BP2−/− donor cells compared to WT. These data confirm that IGFBP2 may be an important regulator of the hematopoietic stem cell niche.

Example 11

IGFBP-2 from Mesenchymal Stromal Cells (MSCs) in the Bone Marrow Niche Regulates Hematopoietic Stem Cell Proliferation and Marrow Engraftment IGFBP2 (BP2) is one of 6 IGF binding proteins that shuttles IGFs to their respective receptors. PTH has been shown to induce IGFBP2 synthesis in calvarial osteoblasts and global deletion of BP2 results in small spleens, very low bone formation, impaired bone resorption and increased marrow adiposity. In vitro, bone marrow from bp2−/− mice show impaired recruitment of both osteoblasts and osteoclasts. BP2 null males also have a hematopoietic phenotype in which increased percentages of lymphoid and myeloid subpopulations are found in both the peripheral blood and spleen. Studies were conducted to determine if BP2 serves a critical role as a proliferative factor in the bone marrow niche. Using RNA from purified mouse mesenchymal stem cells (Stem Cell Technologies), it was first determined that BP2 gene expression levels were 6-8 times higher than in purified B or T cells. Non competitive bone marrow transplants (BMT) were performed by transplanting LY 5.1+ donor cells into lethally irradiated WT and bp2−/− recipients. Donor engraftment was not different between strains as shown by greater than 70% donor cells present in the peripheral blood of recipient mice from both strains. However, in competitive repopulation transplantation using same strain donor-recipient pairs, bp2−/− donor cells engrafted bp2−/− recipient bone marrow 30% less efficiently (P=0.01) than WT transplants. In addition, there were significantly fewer mature lymphoid (CD3, CD19) and myeloid (CD11b, LY6G and F480) cells in the peripheral blood of bp2−/− recipients (p≤0.05). In response to administration of a single component of the IGFBP2 molecule, the heparin binding domain (HBD), to bp2−/− mice, trabecular bone mass was rescued and osteoblast number increased. Importantly, in vivo administration of the HBD suppressed the percentages of mature monocytes, macrophages and neutrophils in the peripheral circulation, comparable to those found in WT mice. Taken together these data demonstrate that BP2, which is synthesized by MSCs and inducible by PTH, is a potent regulator of hematopoiesis and may specifically control stem cell fate in an IGF binding independent manner within the marrow niche. Niche regulation by IGFBP2 may be therapeutically important to clinical bone marrow transplantation which is currently the only treatment option for many hematologic and solid tissue malignancies.

Example 12

Regulation of Hematopoietic Stem Cells by the Heparin Binding Domain of IGFBP-2

The following studies are described to determine the role of IGFBP-2, through its heparin binding domain, in enhancing the success of bone marrow transplantation by stimulating hematopoietic bone marrow repopulation.

Rationale.

Hematopoietic stem cell transplantation is used primarily in the treatment of hematopoietic cancers (leukemias and lymphomas), following high dose chemotherapy for non hematopoietic malignancies. It is also used for diseases involving genetic or acquired bone marrow failure, such as aplastic anemia and autoimmune diseases. Positive transplant outcomes are dependent upon (1) retrieval of sufficient numbers of hematopoietic stem cells (HSCs) from donor bone marrow, cord blood or peripheral blood and (2) successful homing of HSCs to the recipient's bone marrow[1]. IGFBP-2 has been shown to be a necessary factor for the in vitro proliferation of both human and murine hematopoietic stem cells[2,3]. Consistent with this result, it has been found that global deletion of IGFBP-2 in mice results in compromised repopulation of the bone marrow following lethal irradiation. A peptide unique to the heparin binding domain (HBD) of IGFBP-2 has been synthesized and it has been demonstrated that this peptide has the ability to increase osteoblast and bone marrow stromal cell numbers in vitro and to enhance bone formation in vivo independently of IGF signaling. These studies investigate the role of the HBD of IGFBP-2 in hematopoietic stem cell transplantation, a critical component of therapeutic anti-cancer regimens.

Significance.

Successful bone marrow transplantation is an important therapeutic option for both hematologic and solid tissue neoplasms. For example, a major advance in treating multiple myeloma has been the transplantation of bone marrow hematopoietic stem cells (HSCs). Propagation of HSCs prior to transplant increases the likelihood of successful engraftment and re-establishment of steady state hematopoiesis[4]. IGFBP-2 has been shown to be a potent stimulus for the in vitro proliferation of mouse and human hematopoietic stem cells[2,3]. However, the mechanism responsible for this effect is unknown. Recent studies have established the importance of IGFBP-2 for successful in vivo bone marrow transplantation as well as its capacity to stimulate mesenchymal stromal cell (MSC) differentiation. The studies described herein are intended to elucidate the pathways through which IGFBP-2 increases HSC proliferation and enhances establishment of the hematopoietic stem cell niche. As HSC transplantation is widely used as a therapy for both hematopoietic and non hematopoietic malignancies, these studies should have broad therapeutic implications.

Background.

The potential of the stem cell niche to respond to stress and injury requires not only HSCs but also bone forming osteoblasts[5,6]. Insulin-Like Growth Factor Binding Protein 2 (IGFBP-2) is one of six IGF binding proteins (IGFBP 1-6) that regulates the bioavailability of the proliferative growth factors IGF-I and IGF-II. Studies have established the importance of IGFBP-2 in regulating osteoblast proliferation and differentiation[7]. Preliminary evidence suggests that IGFBP-2 can act independently of IGF, but the mechanisms underlying these actions have yet to be investigated. For example, cell mobility in glioblastoma appears to be mediated by the binding of IGFBP-2 to the integrin α5 receptor via the Arg-Gly-Asp (RGD) domain[8]. In addition, proteolytic cleavage of IGFBP2 results in small fragments that include the heparin binding domain (HBD). When the HBD binds to the extracellular matrix, it can stimulate the proliferation and metastatic behavior of neuroblastoma cells[9]. A small molecule containing the HBD present in the linker region of IGFBP-2 has been synthesized. Of the two HBDs in this molecule, the one synthesized is unique to IGFBP-2 and is not represented in other IGFBPs. This peptide is studied for its effect on HSC proliferation, migration, and bone marrow homing with the ultimate goal of defining the usefulness of the HBD as an adjuvant for HSC transplantation therapies.

Data in Support of Proposed Investigation.

Figure 10:
FIG. 10. The HBD of IGFBP-2 increased cell proliferation of osteoblasts and bone marrow stromal cells as compared to full length (FL) IGFBP-2 (BP2) and control peptide and as seen by increased alkaline phosphatase and alizarin red staining, respectively.
Figure 10:
Figure 11:
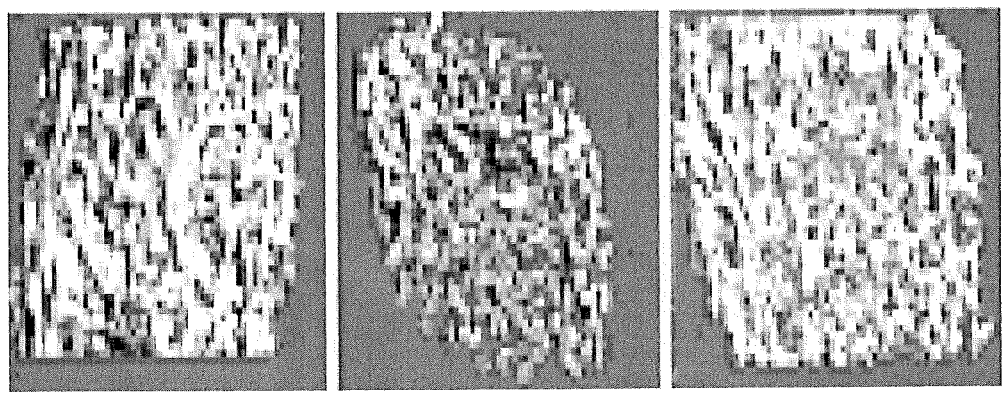
FIG. 11. The HBD of IGBP-2 rescued the low bone mass phenotype of Igfbp2$^{-/-}$ mice in vivo, as shown by μCT analysis.

In the context of bone formation, the IGF independent actions of IGFBP-2 were investigated using a synthesized peptide of the HBD contained in the linker region of IGFBP-2. This peptide is distinct from the other IGF binding proteins. In vitro, the HBD peptide rescued the low bone mineralization phenotype of Igfbp2−/− bone marrow stromal cells and calvarial osteoblasts (FIG. 10) and stimulated periosteal expansion and growth in ex vivo explants of Igfbp2−/− metacarpals. In vivo, the HBD peptide rescued the low bone mass phenotype of Igfbp2−/− mice, as seen by increased osteoblast number, restored bone mass, and improved bone strength (FIG. 11).

Figure 12:
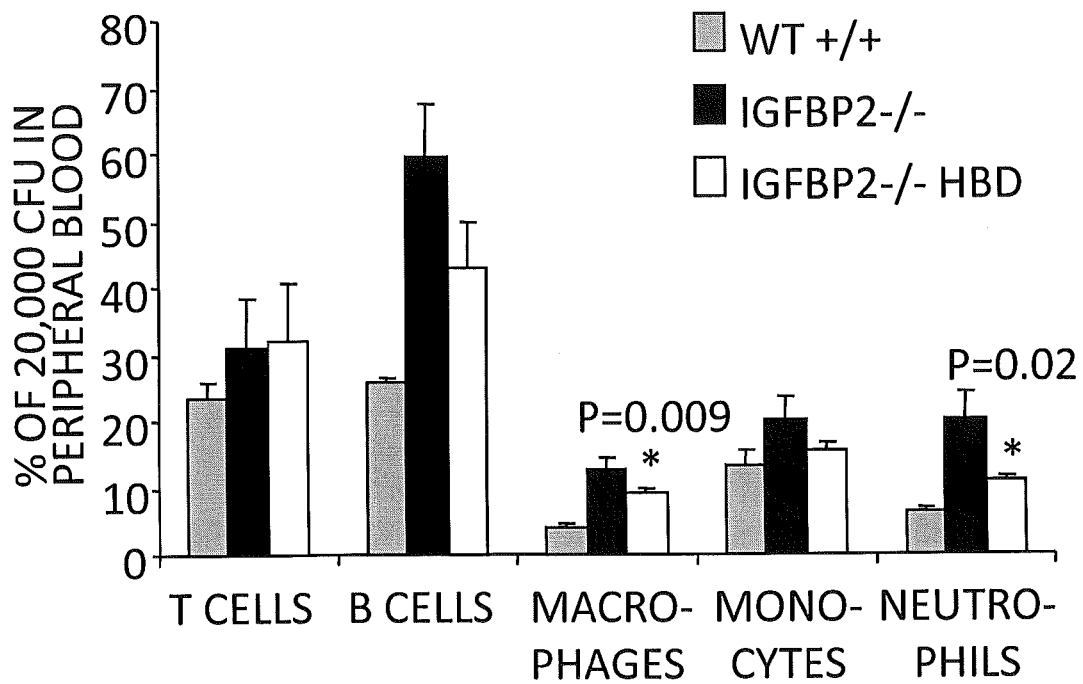
FIG. 12. HBD reversed the increased lymphoid and myeloid hematopoietic phenotype of Igfbp2$^{-/-}$ mice.
Figure 13:
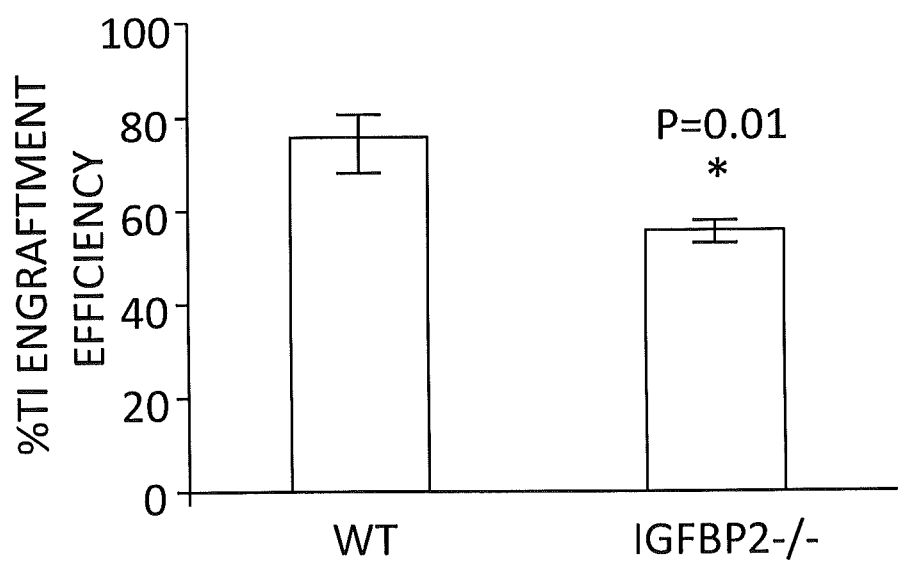
FIG. 13. In competitive re-population bone marrow transplants, Igfbp2$^{-/-}$ bone marrow donor cells repopulated the bone marrow of same-strain recipients with 30% less efficiency than Igfbp2$^{+/+}$ donor cells.

In addition to its actions on mesenchymal cells, IGFBP-2 has been shown to be a necessary factor for the in vitro proliferation of murine and human hematopoietic stem cells. Global deletion of IGFBP-2 results in altered hematopoiesis such that the peripheral blood and spleen of Igfbp2−/− mice contain significantly increased B lymphocytes and myeloid lineage cells. In vivo administration of the HBD reduced the number of differentiated lymphoid and myeloid cells to the baseline percentages of PBS injected controls (FIG. 12). Furthermore, in competitive repopulation bone marrow transplants, Igfbp2−/− donor cells failed to efficiently repopulate the bone marrow of same strain recipients (FIG. 13).

Taken together, these findings indicate that the HBD may be an important component of IGFBP-2 signaling to enhance cell proliferation and suppress differentiation in HSCs. The studies described herein are to determine if the growth promoting effects of IGFBP-2 on HSCs are mediated through the HBD and are independent of the actions of IGF-I.

Investigation of the Effect of the IGFBP-2 Heparin Binding Domain Peptide (HBD) on Hematopoietic Stem Cell Proliferation and Differentiation In Vitro.

Rationale:

Increasing the number of long term (LT) HSCs in donor bone marrow cell preparations prior to bone marrow transplantation improves transplantation outcomes. In vitro, IGFBP-2 acts to increase the proliferation of HSCs, but the mechanism underlying this effect is unknown. IGFBP-2 has been shown to act independently of IGF-1 signaling via the RGD and HBD domains. Using a synthesized HBD peptide unique to IGFBP-2, the ability of the HBD to increase the proliferation of human and murine HSCs and maintain the HSCs in an undifferentiated state will be tested. To delineate IGFBP-2 independent effects, the HBD will be tested in vitro on mouse HSCs collected from both Igfbp2−/− and Igfbp2+/+ mice.

Design and Methods:

The Igfbp2−/− mouse was created by Dr. John Pintar in the 1990s and then backcrossed to B6 by Dr. Terri Wood in the early 2000s. These mice were obtained from Dr. Wood and they continued to be backcrossed to C57BL6 at The Jackson Laboratory. The HBD peptide and scrambled control peptide are provided by David Clemmons, MD, at UNC Chapel Hill. To extend the short half-life, the HBD has been pegylated. In vitro experiments have demonstrated that HBD and the pegylated HBD are identical in their ability to stimulate osteoblast proliferation and differentiation. Human HSCs isolated from cord blood will be purchased from Stem Cell Technologies and cultured in Methocult stem cell media, according to the manufacturer's instructions. Murine bone marrow stromal cells (BMSC) will be recovered from the femurs of Igfbp2−/− and Igfbp2+/+ mice. BMSC will be stained with fluorescently conjugated antibodies and HSCs isolated using the FACSAria cell sorter. HSCs will be defined as $Lin^- CD34^- Sca-1^+ Kit^+ Flk-2^-$. Twenty HSCs from each strain will be cultured in StemSpan serum free media (Stem Cell Technologies) supplemented with heparin, stem cell factor, thrombopoietin, and FGF-1, as previously reported[3]. HBD, full length IGFBP-2, or scrambled control peptide will be added to cell cultures at predetermined concentrations and for optimized exposure time. At day 10 of culture, cell proliferation for test specimens and controls will be quantified by the uptake of $H^3$ Thymidine as counts of radioactivity per minute using the L56500 Liquid Scintillation Counter. Results will be expressed as the average of triplicate tests. Cells will also be analyzed by flow cytometry to determine percentages of short term (ST) and long term (LT) hematopoietic stem cells as defined by $CD34^+ Sca-1^+ Thy1.1^{+/lo} c-kit^+ lin^- CD135^- Slamf1/CD150^+ CD11b^{lo}$ and $CD34^- Sca-1^+ Thy1.1^{+/lo} c-kit^+ lin^- CD135^- Slamf1/CD150^+$ respectively. To confirm that HSCs remain undifferentiated in culture, percentages of differentiated cells will also be determined by flow cytometry using antibodies to lineage specific markers including Ter119 (erythrocytes) LY6G (Gr-1, myeloid), CD3 (T cell), CD19 (B cell) and CD11b (Mac-1, macrophage). Percentages will be based on collection of 20,000 events using the FACSCalibur flow cytometer. Cell culture experiments will be repeated three times. Analysis of variance (ANOVA) will be used to assess differences across groups. The confidence interval will be set at 95% ($p \leq 0.05$).

Investigation of Whether the Effects of the HBD on Hematopoietic Stem Cells are Independent of IGF Signaling.

Rationale.

IGF-I is a growth promoter for both normal and malignant cells. Elevated serum levels of IGFBP-2 are recognized as a poor prognostic indicator in recurrent metastatic disease and in childhood acute myelogenous leukemia following hematopoietic stem cell transplantation[10,11]. It is, therefore, important to determine if the effects of IGFBP-2 on HSC expansion in vitro are independent of IGF signaling and whether there is synergy between IGF and IGFBP-2 with respect to cell signaling.

Design and Methods:

HSCs will be cultured from murine bone marrow stromal cells, as described herein. IGF signaling will be inhibited by blocking the IGF receptor using the alpha IR-3 antibody in murine HSC cultures. The alpha IR-3 antibody used in these experiments has been published as effectively blocking IGF signaling in a variety of cell types, including murine hematopoietic stem cells[12]. In these experiments, successful blocking of the IGF receptor will be assessed by adding IGF 1 to cell cultures and measuring cell proliferation by $H^3$ Thymidine uptake. Following confirmation of receptor blocking, HBD, scrambled peptide and full length IGFBP-2 will be added to HSC cultures, and cell proliferation quantified by H3 Thymidine uptake. Data will be analyzed by ANOVA as described herein.

Investigation of What Signaling Events are Initiated in Hematopoietic Stem Cells by the HBD of IGFBP-2.

Rationale.

HBD has been shown to increase osteoblast proliferation by decreasing PTEN expression and increasing AKT phosphorylation. The mechanisms by which IGFBP-2 increases HSC proliferation have not been determined. Osteoblasts and hematopoietic cells reside together in close proximity in the bone marrow, and many cell signaling pathways are common to both the bone and hematopoietic niches. To determine the signaling events activated by the HBD, gene expression profiling will be performed on HSC cell cultures with and without the HBD, scrambled peptide, and full length IGFBP-2. Through PCR gene arrays, the contribution of cell proliferation and/or inhibition of apoptosis to HSC expansion will be determined.

Design and Methods:

HSCs will be exposed to HBD, full length IGFBP-2, and a scrambled peptide, as described herein. RNA will be extracted from cultured HSCs on day 10 of culture. cDNA will be prepared using the RT2 First Strand Kit (SABiosciences, Frederick, Md.), according to the manufacturer's directions. A small aliquot (i.e., 25 ul) of the experimental cocktail consisting of cDNA, Syber Green RT2 qPCR Master Mix (SABiosciences) will be added to each well of the PCR array in a 96 well plate format (SABiosciences). PCR amplification will be performed using the Bio-Rad iQ5 thermocycler at the following settings: one cycle for 10 minutes at 95° C., followed by 40 cycles of 15 seconds each at 95° C. and 40 cycles of one minute each at 60° C. Baseline and threshold values will be determined manually. The ΔΔCt (delta threshold change) will be calculated for each gene using the SABiosciences PCR Array Data Analysis Web Portal (http://www.SABiosciences.com). A fold change greater than 1 between the experimental ΔCt (delta threshold change) and the control ΔCt will be considered up-regulation of the gene. A fold change less than 1 will be considered down-regulation of the gene. Ct values above 35 will be considered negative. PCR arrays will be performed for apoptosis, hematopoietic stem cells and hematopoiesis, and the PI3K-Akt, Wnt, MAP Kinase and Insulin signaling pathways.

Investigation of the Effect of the HBD of IGFBP-2 on Bone Marrow Transplantation in Vivo.

Determination of Whether the HSCs are Expanded In Vitro Using the HBD of IGFBP-2 Functional in Bone Marrow Transplantation.

Rationale:

While it is important that HSCs remain undifferentiated prior to transplant, successful transplantation is dependent upon a sufficient number of HSCs homing to the bone marrow and differentiating first into progenitor cells and eventually into mature and functional erythrocytes and white blood cells. The ability of the HSCs expanded in vitro by the HBD peptide to repopulate the bone marrow and to maintain steady state hematopoiesis when transplanted into lethally irradiated recipient mice will be tested.

Design and Methods:

Murine HSCs collected from Igfbp2+/+ mice and expanded in vitro by the HBD peptide will be transplanted into Igfbp2+/+ mice. HSCs from human cord blood also expanded by the HBD peptide will be transplanted into non-obese, diabetic, severe combined immunodeficient (NOD/SCID) mice, a strain commonly used for transplantation studies of human bone marrow cells. Recipient mice will receive a lethal dose (10 Gy for IGFBP2+/+) or sublethal dose (3.5 Gy for NOD/SCID) of irradiation by exposure to a Cesium source using the J.L Shepherd 143-45 Irradiator in two sessions and with 4 hours between sessions. Human and murine HSCs will be expanded in culture for 10 days, counted, and resuspended in PBS at a concentration of $10 \times 10^6$ cells/mL. 30 uL of donor HSCs will be transplanted into the retro orbitus of recipient mice. At 8 weeks post transplant, peripheral blood of recipient mice will be tested for successful bone marrow engraftment by determining the percentage of LY5.2+ murine donor cells and CD45/71+ human donor cells by flow cytometry in Igfbp2+/+ and NOD/SCID mice respectively. The presence of ≥80% donor cells will be indicative of successful engraftment. Recipient mice will be sacrificed at 16 weeks post transplant. Percentages of the major blood cell populations will be determined in peripheral blood by flow cytometry using conjugated antibodies to Ter 119 (erythrocytes), LY6G (Gr-1, myeloid), CD3 (T cell), CD19 (B cell), and CD11b (Mac-1, macrophage). As a functional test of successful engraftment and an assessment of the self renewal potential of transplanted HSCs, bone marrow cells will be collected from one femur of recipient mice at 16 weeks post transplant and used as the donor cells for a second set of transplant recipients. These second set recipients will be monitored as described for the original transplants. Three mice for each test and control condition will be transplanted, and transplants will be performed in at least 2 independent experiments for an N=6 for each experimental condition. ANOVA will be used to analyze differences between groups as previously described. Investigation of Whether the HBD Increases the Efficiency of Bone Marrow Repopulation Following Myeloablation in Igfbp2−/− Mice.

Rationale.

It has been shown that global deletion of IGFBP-2 in Igfbp2−/− bone marrow transplant recipients does not preclude successful engraftment of IGFBP-2 positive donor cells. However, as seen in competitive repopulation transplant experiments, donor cells from Igfbp2−/− mice engraft 30% less efficiently when compared with Igfbp2+/+ donor cells. Taken together, these data implicate IGFBP-2 as an important regulator of HSC homing to the bone marrow and a contributor to establish HSCs within the hematopoietic stem cell niche. Both of these steps are required for successful transplantation. The goal in these experiments is to rescue the decreased engraftment efficiency of Igfbp2−/− donor cells by co-administering HBD peptide to Igfbp2−/− transplant recipients. These experiments will serve as a functional test of the ability of the HBD to improve engraftment of bone marrow cells.

Design and Methods:

The LY5.1/LY5.2 gene system will be used in competitive experiments to repopulate the bone marrow and distinguish donor engrafted bone marrow cells from recipient endogenous bone marrow cells. The B6.SJL-Ptprc$^a$pepc$^b$/BoyJ mouse strain (LY5.1 positive) will be used as the source of competitor bone marrow donor cells. All recipient mice will be LY5.2 positive. Donor and recipient mice will be male and 8 weeks of age at the time of transplant. To obtain donor bone marrow cells, mice will be sacrificed, and the femurs will be recovered aseptically. Bone marrow cells will be collected, washed, and resuspended in phosphate buffered saline (PBS) at a concentration of $0.3 \times 10^6$ cells per 30 uL injection volume. For competitive repopulation transplants, LY5.1+ donor cells are mixed with LY5.2+ (Igfbp2−/− or Igfbp2+/+) donor cells at 1:0 (100% LY5.1 donor cells, positive control), 1:3 and 1:6 ratios. The HBD peptide, scrambled peptide, or full length IGFBP2 will be added to donor cell preparations at a concentration optimized in previous in vivo experiments (50 ug/30 uL). Recipient mice will be irradiated lethally and transplanted, as described herein. At 8 weeks post transplant, percentages of LY5.1 positive and LY5.2 positive engrafted donor cells will be determined in peripheral blood by flow cytometry. Transplant recipients will be sacrificed at 16 weeks post transplant, and white blood cell populations analyzed by flow cytometry. HSCs present in the bone marrow will be quantified and sorted using the FACSAria cell sorter. Sorted cells will be cultured and the number of colony forming units determined in a standard colony forming cell culture assay (Stem Cell Technologies). In addition, functionality of transplanted HSCs will be assessed by a second set of transplants, which will be performed as described herein. Three mice for each test and control condition will be transplanted, and transplants will be performed in at least 2 independent experiments for an N=6 for each experimental condition. ANOVA will be used to assess statistical significance between group means of test (Igfbp2−/−) and control (Igfbp2+/+) recipients. The confidence interval will be set at ≤0.05.

REFERENCE LIST FOR EXAMPLE 12

1. Jenq, R. R. & van den Brink, M. R. Allogeneic haematopoietic stem cell transplantation: individualized stem cell and immune therapy of cancer. *Nat Rev Cancer* 10, 213-21.
2. Huynh, H. et al. Insulin-like growth factor-binding protein 2 secreted by a tumorigenic cell line supports ex vivo expansion of mouse hematopoietic stem cells. *Stem Cells* 26, 1628-35 (2008).
3. Zhang, C. C., Kaba, M., Iizuka, S., Huynh, H. & Lodish, H. F. Angiopoietin-like 5 and IGFBP2 stimulate ex vivo expansion of human cord blood hematopoietic stem cells as assayed by NOD/SCID transplantation. Blood 111, 3415-23 (2008).
4. Pulte, D., Gondos, A. & Brenner, H. Trends in survival after diagnosis with hematologic malignancy in adolescence or young adulthood in the United States, 1981-2005. Cancer 115, 4973-9 (2009).
5. Calvi, L. M. et al. Osteoblastic cells regulate the haematopoietic stem cell niche. Nature 425, 841-6 (2003).
6. Wilson, A. & Trumpp, A. Bone-marrow haematopoietic-stem-cell niches. Nat Rev Immunol 6, 93-106 (2006).
7. DeMambro, V. E. et al. Gender-specific changes in bone turnover and skeletal architecture in igfbp-2-null mice. Endocrinology 149, 2051-61 (2008).
8. Song, S. W. et al. IIp45, an insulin-like growth factor binding protein 2 (IGFBP-2) binding protein, antagonizes IGFBP-2 stimulation of glioma cell invasion. Proc Natl Acad Sci USA 100, 13970-5 (2003).
9. Russo, V. C. et al. Insulin-like growth factor binding protein-2 binding to extracellular matrix plays a critical role in neuroblastoma cell proliferation, migration, and invasion. Endocrinology 146, 4445-55 (2005).

10. Dawczynski, K. et al. Elevated serum insulin-like growth factor binding protein-2 is associated with a high relapse risk after hematopoietic stem cell transplantation in childhood AML. Bone Marrow Transplant 37, 589-94 (2006).
11. Dawczynski, K., Kauf, E. & Zintl, F. Changes of serum growth factors (IGF-I, -II and IGFBP-2, -3) prior to and after stem cell transplantation in children with acute leukemia. Bone Marrow Transplant 32, 411-5 (2003).
12. Zia, F. et al. Monoclonal antibody alpha IR-3 inhibits non-small cell lung cancer growth in vitro and in vivo. J Cell Biochem Suppl 24, 269-75 (1996).
13. Frisch, B. J., Porter, R. L. & Calvi, L. M. Hematopoietic niche and bone meet. Curr Opin Support Palliat Care 2, 211-7 (2008).
14. Kuznetsov, S. A. et al. The interplay of osteogenesis and hematopoiesis: expression of a constitutively active PTH/PTHrP receptor in osteogenic cells perturbs the establishment of hematopoiesis in bone and of skeletal stem cells in the bone marrow. J Cell Biol 167, 1113-22 (2004).
15. Ballen, K. K.; King, R. J.; Chitphakdithai, P.; Bolan, C. D., Jr.; Agura, E.; Hartzman, R. J.; Kennan, N. A., The national marrow donor program 20 years of unrelated donor hematopoietic cell transplantation. *Biol Blood Marrow Transplant* 2008, 14, (9 Suppl), 2-7.
16. Bendall, S. C.; Stewart, M. H.; Menendez, P.; George, D.; Vijayaragavan, K.; Werbowetski-Ogilvie, T.; Ramos-Mejia, V.; Rouleau, A.; Yang, J.; Bosse, M.; Lajoie, G.; Bhatia, M., IGF and FGF cooperatively establish the regulatory stem cell niche of pluripotent human cells in vitro. *Nature* 2007, 448, (7157), 1015-21.
17. Bhattacharya, D.; Rossi, D. J.; Bryder, D.; Weissman, I. L., Purified hematopoietic stem cell engraftment of rare niches corrects severe lymphoid deficiencies without host conditioning. *J Exp Med* 2006, 203, (1), 73-85.
18. Clawson, T. F.; Lee, W. H.; Yoder, M. C., Differential expression of insulin-like growth factor binding proteins in murine hematopoietic stromal cell lines. *Mol Cell Endocrinol* 1996, 120, (1), 59-66.
19. Czechowicz, A.; Kraft, D.; Weissman, I. L.; Bhattacharya, D., Efficient transplantation via antibody-based clearance of hematopoietic stem cell niches. *Science* 2007, 318, (5854), 1296-9.
20. Delaney, C.; Heimfeld, S.; Brashem-Stein, C.; Voorhies, H.; Manger, R. L.; Bernstein, I. D., Notch-mediated expansion of human cord blood progenitor cells capable of rapid myeloid reconstitution. *Nat Med* 16, (2), 232-6.
21. Eminli, S.; Foudi, A.; Stadtfeld, M.; Maherali, N.; Ahfeldt, T.; Mostoslaysky, G.; Hock, H.; Hochedlinger, K., Differentiation stage determines potential of hematopoietic cells for reprogramming into induced pluripotent stem cells. *Nat Genet.* 2009, 41, (9), 968-76.
22. Forsberg, E. C.; Bhattacharya, D.; Weissman, I. L., Hematopoietic stem cells: expression profiling and beyond. *Stem Cell Rev* 2006, 2, (1), 23-30.
23. Frisch, B. J.; Porter, R. L.; Gigliotti, B. J.; Olm-Shipman, A. J.; Weber, J. M.; O'Keefe, R. J.; Jordan, C. T.; Calvi, L. M., In vivo prostaglandin E2 treatment alters the bone marrow microenvironment and preferentially expands short-term hematopoietic stem cells. *Blood* 2009, 114, (19), 4054-63.
24. Fu, P.; Thompson, J. A.; Bach, L. A., Promotion of cancer cell migration: an insulin-like growth factor (IGF)-independent action of IGF-binding protein-6. *J Biol Chem* 2007, 282, (31), 22298-306.
25. Haug, J. S.; He, X. C.; Grindley, J. C.; Wunderlich, J. P.; Gaudenz, K.; Ross, J. T.; Paulson, A.; Wagner, K. P.; Xie, Y.; Zhu, R.; Yin, T.; Perry, J. M.; Hembree, M. J.; Redenbaugh, E. P.; Radice, G. L.; Seidel, C.; Li, L., N-cadherin expression level distinguishes reserved versus primed states of hematopoietic stem cells. *Cell Stem Cell* 2008, 2, (4), 367-79.
26. Hoeflich, A.; Reisinger, R.; Lahm, H.; Kiess, W.; Blum, W. F.; Kolb, H. J.; Weber, M. M.; Wolf, E., Insulin-like growth factor-binding protein 2 in tumorigenesis: protector or promoter? *Cancer Res* 2001, 61, (24), 8601-10.

The foregoing is illustrative of the present invention, and is not to be construed as limiting thereof. The invention is defined by the following claims, with equivalents of the claims to be included therein.

TABLE 1

MicroCT analysis of femurs from IGFBP2$^{+/+}$ and IGFBP2$^{-/-}$ treated with PBS or PEG-HBD-peptide

| | IGFBP2$^{+/+}$ PBS N = 8 | IGFBP2$^{-/-}$ PBS N = 12 | IGFBP2$^{-/-}$ PEG-HBD N = 6 |
|---|---|---|---|
| Midshaft | | | |
| Cortical thickness | 0.198 ± 0.007 | 0.197 ± 0.003 | 0.200 ± 0.006 |
| Bone area | 0.889 ± 0.047 | 0.868 ± 0.018 | 0.903 ± 0.024 |
| Total area | 1.970 ± 0.062 | 1.955 ± 0.036 | 2.076 ± 0.031[a] |
| Bone area/Total area | 0.449 ± 0.011 | 0.444 ± 0.006 | 0.435 ± 0.014 |
| Distal Femur | | | |
| Bone volume/Total volume | 0.143 ± 0.017 | 0.095 ± 0.007[b] | 0.125 ± 0.012[c] |
| Trabecular number | 4.86 ± 0.16 | 429 ± 0.09[b] | 4.47 ± 0.15 |
| Trabecular thickness | 0.047 ± 0.003 | 0.041 ± 0.001 | 0.048 ± 0.002[d] |
| Trabecular spacing | 0.200 ± 0.007 | 0.230 ± 0.005[b] | 0.221 ± 0.008 |

PEG-HBD; pegylated heparin-binding domain
Values are expressed as the mean ± SEM.
[a] $p < 0.05$ vs IGFBP2$^{-/-}$ with PBS
[b] $p < 0.01$ vs IGFBP2$^{+/+}$ with PBS
[c] $p < 0.05$ vs IGFBP2$^{-/-}$ with PBS
[d] $p < 0.01$ vs IGFBP2$^{-/-}$ with PBS

TABLE 2

IGFBP-2 Heparin Binding Peptide Reduces Fat Mass

| Treatment Group | Number of mice | Body Weight (gms) | Fat Mass (gms) |
|---|---|---|---|
| IGFBP-2 −/− + placebo | 8 | 30.4 ± 1.5 | 6.21 ± 0.76 |
| IGFBP-2 −/− + HBD | 8 | 24.9 ± 1.3 | 3.67 ± 0.36 |
| IGFBP-2 +/+ | 8 | 25.2 ± 1.1 | 3.82 ± 0.67 |

TABLE 3

Body composition of Igfbp2$^{-/-}$ mice before treatment with PBS or PEG-HBD.

| | Igfbp2$^{-/-}$ PBS | Igfbp2$^{-/-}$ PEG-HBD |
|---|---|---|
| Whole-body BMD | 0.0378 ± 0.0009 | 0.0382 + 0.0008 |
| Whole-body BMC/Body weight | 0.0115 ± 0.0004 | 0.0119 ± 0.0006 |
| % body fat | 10.4 ± 0.52 | 9.8 ± 0.62 |

PEG-RBD; pegylated heparin-binding domain
BMD; bone mineral density
BMC; bone mineral content
BW; body weight

TABLE 4

Body composition of Igfbp2⁻/⁻ mice after treatment with PBS or PEG-HBD.

|  | Igfbp2⁻/⁻ PBS | Igfbp2⁻/⁻ PEG-HBD |
|---|---|---|
| Whole-body BMD | 0.0445 ± 0.0006 | 0.0459 ± 0.0004 |
| Whole-body BMC/BW | 0.0138 ± 0.0004 | 0.0147 ± 0.0005 |
| % body fat | 10.4 ± 0.70 | 10.4 ± 1.02 |
| Epidydymal fat weight/BW (mg/g) | 12.2 ± 0.51 | 12.2 ± 0.67 |

PEG-HBD; pegylated heparin-binding domain
BMD; bone mineral density
BMC; bone mineral content
BW; body weight

TABLE 5

MicroCT analysis of vertebrae (L5) from IGFBP2⁺/⁺ and IGFBP2⁻/⁻ treated with PBS or PEG-HBD

|  | IGFBP2⁺/⁺ PBS N = 7 | IGFBP2⁻/⁻ PBS N = 9 | IGFBP2⁻/⁻ PEG-HBD N = 6 |
|---|---|---|---|
| Bone volume/Total volume | 0.314 ± 0.020 | 0.278 ± 0.010 | 0.305 ± 0.012 |
| Trabecular number | 6.15 ± 0.36 | 5.77 ± 0.11 | 5.70 ± 0.10 |
| Trabecular thickness | 0.052 ± 0.002 | 0.049 ± 0.001 | 0.054 ± 0.002[a] |
| Trabecular spacing | 0.155 ± 0.009 | 0.160 ± 0.004 | 0.161 ± 0.004 |

PEG-HBD; pegylated heparin-binding domain
Values are expressed as the mean ± SEM.
[a] $p < 0.05$ vs IGFBP2⁻/⁻ with PBS

TABLE 6

Histomorphometric analysis of femur from IGFBP2⁻/⁻ mice treated with PBS or PEG-HBD.

|  | IGFBP2⁻/⁻ PBS N = 5 | IGFBP2⁻/⁻ PEG-HBD N = 5 |
|---|---|---|
| OS/BS (%) | 238 ± 1.11 | 3.56 ± 0.44 |
| ObS/BS (%) | 11.5 ± 1.03 | 16.26 ± 1.42[a] |
| Nob/BPm (/mm) | 12.31 ± 0.52 | 16.3 ± 1.4[a] |
| ES/BS (%) | 17.11 ± 0.93 | 14.79 ± 01.58 |
| OcS/BS (%) | 11.02 ± 0.87 | 9.14 ± 0.90 |
| Noc/BPm (/mm) | 5.19 ± 0.37 | 4.37 ± 0.39 |
| MAR (μm/day) | 0.873 ± 0.0078 | 0.91 ± 0.0453 |
| BFR/BSd (μm3/μm2/day) | 0.0796 ± 0.0164 | 0.080 ± 0.0191 |

PEG-HBD; pegylated heparin-binding domain, OS; osteoid surface, BS; bone surface, ObS; osteoblast surface, Nob; osteoblast number, BPm; bone perimeter, ES; erosion surface, OcS; osteoclast surface, Noc; osteoclast number, MAR; mineral apposition rate, BFR; bone formation rate
Values are expressed as the mean ± SEM
[a] $p < 0.05$ vs IGFBP2⁻/⁻ with PBS

TABLE 7

SEQ ID NO. shown to left of sequence (cont'd)

| 5. | KHHLGLEEPKK; |
|---|---|
| 6. | RHHLGLEEPKK; |
| 7. | HHHLGLEEPKK; |
| 8. | KKHLGLEEPKK; |
| 9. | RKHLGLEEPKK; |
| 10. | HKHLGLEEPKK; |

TABLE 7-continued

SEQ ID NO. shown to left of sequence (cont'd)

| 11. | KRHLGLEEPKK; |
|---|---|
| 12. | RRHLGLEEPKK; |
| 13. | HRHLGLEEPKK; |
| 14. | KHKLGLEEPKK; |
| 15. | RHKLGLEEPKK; |
| 16. | HHKLGLEEPKK; |
| 17. | KKKLGLEEPKK; |
| 18. | RKKLGLEEPKK; |
| 19. | HKKLGLEEPKK; |
| 20. | KRKLGLEEPKK; |
| 21. | RRKLGLEEPKK; |
| 22. | HRKLGLEEPKK; |
| 23. | KHRLGLEEPKK; |
| 24. | RHRLGLEEPKK; |
| 25. | HHRLGLEEPKK; |
| 26. | KKRLGLEEPKK; |
| 27. | RKRLGLEEPKK; |
| 28. | HKRLGLEEPKK; |
| 29. | KRRLGLEEPKK; |
| 30. | RRRLGLEEPKK; |
| 31. | HRRLGLEEPKK; |
| 32. | KHHIGLEEPKK; |
| 33. | RHHIGLEEPKK; |
| 34. | HHHIGLEEPKK; |
| 35. | KKHIGLEEPKK; |
| 36. | RKHIGLEEPKK; |
| 37. | HKHIGLEEPKK; |
| 38. | KRHIGLEEPKK; |
| 39. | RRHIGLEEPKK; |
| 40. | HRHIGLEEPKK; |
| 41. | KHKIGLEEPKK; |
| 42. | RHKIGLEEPKK; |
| 43. | HHKIGLEEPKK; |
| 44. | KKKIGLEEPKK; |
| 45. | RKKIGLEEPKK; |
| 46. | HKKIGLEEPKK; |
| 47. | KRKIGLEEPKK; |
| 48. | RRKIGLEEPKK; |
| 49. | HRKIGLEEPKK; |

TABLE 7-continued

SEQ ID NO. shown to left of sequence(cont'd)

| SEQ ID NO. | Sequence |
|---|---|
| 50. | KHRIGLEEPKK; |
| 51. | RHRIGLEEPKK; |
| 52. | HHRIGLEEPKK; |
| 53. | KKRIGLEEPKK; |
| 54. | RKRIGLEEPKK; |
| 55. | HKRIGLEEPKK; |
| 56. | KRRIGLEEPKK; |
| 57. | RRRIGLEEPKK; |
| 58. | HRRIGLEEPKK; |
| 59. | KHHVGLEEPKK; |
| 60. | RHHVGLEEPKK; |
| 61. | HHHVGLEEPKK; |
| 62. | KKHVGLEEPKK; |
| 63. | RKHVGLEEPKK; |
| 64. | HKHVGLEEPKK; |
| 65. | KRHVGLEEPKK; |
| 66. | RRHVGLEEPKK; |
| 67. | HRHVGLEEPKK; |
| 68. | KHKVGLEEPKK; |
| 69. | RHKVGLEEPKK; |
| 70. | HHKVGLEEPKK; |
| 71. | KKKVGLEEPKK; |
| 72. | RKKVGLEEPKK; |
| 73. | HKKVGLEEPKK; |
| 74. | KRKVGLEEPKK; |
| 75. | RRKVGLEEPKK; |
| 76. | HRKVGLEEPKK; |
| 77. | KHRVGLEEPKK; |
| 78. | RHRVGLEEPKK; |
| 79. | HHRVGLEEPKK; |
| 80. | KKRVGLEEPKK; |
| 81. | RKRVGLEEPKK; |
| 82. | HKRVGLEEPKK; |
| 83. | KRRVGLEEPKK; |
| 84. | RRRVGLEEPKK; |
| 85. | HRRVGLEEPKK; |
| 86. | KHHLGIEEPKK; |
| 87. | RHHLGIEEPKK; |
| 88. | HHHLGIEEPKK; |
| 89. | KKHLGIEEPKK; |
| 90. | RKHLGIEEPKK; |
| 91. | HKHLGIEEPKK; |
| 92. | KRHLGIEEPKK; |
| 93. | RRHLGIEEPKK; |
| 94. | HRHLGIEEPKK; |
| 95. | KHKLGIEEPKK; |
| 96. | RHKLGIEEPKK; |
| 97. | HHKLGIEEPKK; |
| 98. | KKKLGIEEPKK; |
| 99. | RKKLGIEEPKK; |
| 100. | HKKLGIEEPKK; |
| 101. | KRKLGIEEPKK; |
| 102. | RRKLGIEEPKK; |
| 103. | HRKLGIEEPKK; |
| 104. | KHRLGIEEPKK; |
| 105. | RHRLGIEEPKK; |
| 106. | HHRLGIEEPKK; |
| 107. | KKRLGIEEPKK; |
| 108. | RKRLGIEEPKK; |
| 109. | HKRLGIEEPKK; |
| 110. | KRRLGIEEPKK; |
| 111. | RRRLGIEEPKK; |
| 112. | HRRLGIEEPKK; |
| 113. | KHHIGIEEPKK; |
| 114. | RHHIGIEEPKK; |
| 115. | HHHIGIEEPKK; |
| 116. | KKHIGIEEPKK; |
| 117. | RKHIGIEEPKK; |
| 118. | HKHIGIEEPKK; |
| 119. | KRHIGIEEPKK; |
| 120. | RRHIGIEEPKK; |
| 121. | HRHIGIEEPKK; |
| 122. | KHKIGIEEPKK; |
| 123. | RHKIGIEEPKK; |
| 124. | HHKIGIEEPKK; |
| 125. | KKKIGIEEPKK; |
| 126. | RKKIGIEEPKK; |
| 127. | HKKIGIEEPKK; |

TABLE 7-continued

SEQ ID NO. shown to left of sequence(cont'd)

| SEQ ID NO. | Sequence |
|---|---|
| 128. | KRKIGIEEPKK; |
| 129. | RRKIGIEEPKK; |
| 130. | HRKIGIEEPKK; |
| 131. | KHRIGIEEPKK; |
| 132. | RHRIGIEEPKK; |
| 133. | HHRIGIEEPKK; |
| 134. | KKRIGIEEPKK; |
| 135. | RKRIGIEEPKK; |
| 136. | HKRIGIEEPKK; |
| 137. | KRRIGIEEPKK; |
| 138. | RRRIGIEEPKK; |
| 139. | HRRIGIEEPKK; |
| 140. | KHHVGIEEPKK; |
| 141. | RHHVGIEEPKK; |
| 142. | HHHVGIEEPKK; |
| 143. | KKHVGIEEPKK; |
| 144. | RKHVGIEEPKK; |
| 145. | HKHVGIEEPKK; |
| 146. | KRHVGIEEPKK; |
| 147. | RRHVGIEEPKK; |
| 148. | HRHVGIEEPKK; |
| 149. | KHKVGIEEPKK; |
| 150. | RHKVGIEEPKK; |
| 151. | HHKVGIEEPKK; |
| 152. | KKKVGIEEPKK; |
| 153. | RKKVGIEEPKK; |
| 154. | HKKVGIEEPKK; |
| 155. | KRKVGIEEPKK; |
| 156. | RRKVGIEEPKK; |
| 157. | HRKVGIEEPKK; |
| 158. | KHRVGIEEPKK; |
| 159. | RHRVGIEEPKK; |
| 160. | HHRVGIEEPKK; |
| 161. | KKRVGIEEPKK; |
| 162. | RKRVGIEEPKK; |
| 163. | HKRVGIEEPKK; |
| 164. | KRRVGIEEPKK; |
| 165. | RRRVGIEEPKK; |
| 166. | HRRVGIEEPKK; |
| 167. | KHHLGVEEPKK; |
| 168. | RHHLGVEEPKK; |
| 169. | HHHLGVEEPKK; |
| 170. | KKHLGVEEPKK; |
| 171. | RKHLGVEEPKK; |
| 172. | HKHLGVEEPKK; |
| 173. | KRHLGVEEPKK; |
| 174. | RRHLGVEEPKK; |
| 175. | HRHLGVEEPKK; |
| 176. | KHKLGVEEPKK; |
| 177. | RHKLGVEEPKK; |
| 178. | HHKLGVEEPKK; |
| 179. | KKKLGVEEPKK; |
| 180. | RKKLGVEEPKK; |
| 181. | HKKLGVEEPKK; |
| 182. | KRKLGVEEPKK; |
| 183. | RRKLGVEEPKK; |
| 184. | HRKLGVEEPKK; |
| 185. | KHRLGVEEPKK; |
| 186. | RHRLGVEEPKK; |
| 187. | HHRLGVEEPKK; |
| 188. | KKRLGVEEPKK; |
| 189. | RKRLGVEEPKK; |
| 190. | HKRLGVEEPKK; |
| 191. | KRRLGVEEPKK; |
| 192. | RRRLGVEEPKK; |
| 193. | HRRLGVEEPKK; |
| 194. | KHHIGVEEPKK; |
| 195. | RHHIGVEEPKK; |
| 196. | HHHIGVEEPKK; |
| 197. | KKHIGVEEPKK; |
| 198. | RKHIGVEEPKK; |
| 199. | HKHIGVEEPKK; |
| 200. | KRHIGVEEPKK; |
| 201. | RRHIGVEEPKK; |
| 202. | HRHIGVEEPKK; |
| 203. | KHKIGVEEPKK; |
| 204. | RHKIGVEEPKK; |
| 205. | HHKIGVEEPKK; |

TABLE 7-continued

| SEQ ID NO. | shown to left of sequence(cont'd) |
|---|---|
| 206. | KKKIGVEEPKK; |
| 207. | RKKIGVEEPKK; |
| 208. | HKKIGVEEPKK; |
| 209. | KRKIGVEEPKK; |
| 210. | RRKIGVEEPKK; |
| 211. | HRKIGVEEPKK; |
| 212. | KHRIGVEEPKK; |
| 213. | RHRIGVEEPKK; |
| 214. | HHRIGVEEPKK; |
| 215. | KKRIGVEEPKK; |
| 216. | RKRIGVEEPKK; |
| 217. | HKRIGVEEPKK; |
| 218. | KRRIGVEEPKK; |
| 219. | RRRIGVEEPKK; |
| 220. | HRRIGVEEPKK; |
| 221. | KHHVGVEEPKK; |
| 222. | RHHVGVEEPKK; |
| 223. | HHHVGVEEPKK; |
| 224. | KKHVGVEEPKK; |
| 225. | RKHVGVEEPKK; |
| 226. | HKHVGVEEPKK; |
| 227. | KRHVGVEEPKK; |
| 228. | RRHVGVEEPKK; |
| 229. | HRHVGVEEPKK; |
| 230. | KHKVGVEEPKK; |
| 231. | RHKVGVEEPKK; |
| 232. | HHKVGVEEPKK; |
| 233. | KKKVGVEEPKK; |
| 234. | RKKVGVEEPKK; |
| 235. | HKKVGVEEPKK; |
| 236. | KRKVGVEEPKK; |
| 237. | RRKVGVEEPKK; |
| 238. | HRKVGVEEPKK; |
| 239. | KHRVGVEEPKK; |
| 240. | RHRVGVEEPKK; |
| 241. | HHRVGVEEPKK; |
| 242. | KKRVGVEEPKK; |
| 243. | RKRVGVEEPKK; |
| 244. | HKRVGVEEPKK; |

TABLE 7-continued

| SEQ ID NO. | shown to left of sequence(cont'd) |
|---|---|
| 245. | KRRVGVEEPKK; |
| 246. | RRRVGVEEPKK; |
| 247. | HRRVGVEEPKK; |
| 248. | KHHLGLNEPKK; |
| 249. | RHHLGLNEPKK; |
| 250. | HHHLGLNEPKK; |
| 251. | KKHLGLNEPKK; |
| 252. | RKHLGLNEPKK; |
| 253. | HKHLGLNEPKK; |
| 254. | KRHLGLNEPKK; |
| 255. | RRHLGLNEPKK; |
| 256. | HRHLGLNEPKK; |
| 257. | KHKLGLNEPKK; |
| 258. | RHKLGLNEPKK; |
| 259. | HHKLGLNEPKK; |
| 260. | KKKLGLNEPKK; |
| 261. | RKKLGLNEPKK; |
| 262. | HKKLGLNEPKK; |
| 263. | KRKLGLNEPKK; |
| 264. | RRKLGLNEPKK; |
| 265. | HRKLGLNEPKK; |
| 266. | KHRLGLNEPKK; |
| 267. | RHRLGLNEPKK; |
| 268. | HHRLGLNEPKK; |
| 269. | KKRLGLNEPKK; |
| 270. | RKRLGLNEPKK; |
| 271. | HKRLGLNEPKK; |
| 272. | KRRLGLNEPKK; |
| 273. | RRRLGLNEPKK; |
| 274. | HRRLGLNEPKK; |
| 275. | KHHIGLNPKK; |
| 276. | RHHIGLNEPKK; |
| 277. | HHHIGLNEPKK; |
| 278. | KKHIGLNEPKK; |
| 279. | RKHIGLNEPKK; |
| 280. | HKHIGLNEPKK; |
| 281. | KRHIGLNEPKK; |
| 282. | RRHIGLNEPKK; |
| 283. | HRHIGLNEPKK; |

TABLE 7-continued

SEQ ID NO. shown to left of sequence(cont'd)

| SEQ ID NO. | Sequence |
|---|---|
| 284. | KHKIGLNEPKK; |
| 285. | RHKIGLNEPKK; |
| 286. | HHKIGLNEPKK; |
| 287. | KKKIGLNEPKK; |
| 288. | RKKIGLNEPKK; |
| 289. | HKKIGLNEPKK; |
| 290. | KRKIGLNEPKK; |
| 291. | RRKIGLNEPKK; |
| 292. | HRKIGLNEPKK; |
| 293. | KHRIGLNEPKK; |
| 294. | RHRIGLNEPKK; |
| 295. | HHRIGLNEPKK; |
| 296. | KKRIGLNEPKK; |
| 297. | RKRIGLNEPKK; |
| 298. | HKRIGLNEPKK; |
| 299. | KRRIGLNEPKK; |
| 300. | RRRIGLNEPKK; |
| 301. | HRRIGLNEPKK; |
| 302. | KHHVGLNEPKK; |
| 303. | RHHVGLNEPKK; |
| 304. | HHHVGLNEPKK; |
| 305. | KKHVGLNEPKK; |
| 306. | RKHVGLNEPKK; |
| 307. | HKHVGLNEPKK; |
| 308. | KRHVGLNEPKK; |
| 309. | RRHVGLNEPKK; |
| 310. | HRHVGLNEPKK; |
| 311. | KHKVGLNEPKK; |
| 312. | RHKVGLNEPKK; |
| 313. | HHKVGLNEPKK; |
| 314. | KKKVGLNEPKK; |
| 315. | RKKVGLNEPKK; |
| 316. | HKKVGLNEPKK; |
| 317. | KRKVGLNEPKK; |
| 318. | RRKVGLNEPKK; |
| 319. | HRKVGLNEPKK; |
| 320. | KHRVGLNEPKK; |
| 321. | RHRVGLNEPKK; |
| 322. | HHRVGLNEPKK; |
| 323. | KKRVGLNEPKK; |
| 324. | RKRVGLNEPKK; |
| 325. | HKRVGLNEPKK; |
| 326. | KRRVGLNEPKK; |
| 327. | RRRVGLNEPKK; |
| 328. | HRRVGLNEPKK; |
| 329. | KHHLGINEPKK; |
| 330. | RHHLGINEPKK; |
| 331. | HHHLGINEPKK; |
| 332. | KKHLGINEPKK; |
| 333. | RKHLGINEPKK; |
| 334. | HKHLGINEPKK; |
| 335. | KRHLGINEPKK; |
| 336. | RRHLGINEPKK; |
| 337. | HRHLGINEPKK; |
| 338. | KHKLGINEPKK; |
| 339. | RHKLGINEPKK; |
| 340. | HHKLGINEPKK; |
| 341. | KKKLGINEPKK; |
| 342. | RKKLGINEPKK; |
| 343. | HKKLGINEPKK; |
| 344. | KRKLGINEPKK; |
| 345. | RRKLGINEPKK; |
| 346. | HRKLGINEPKK; |
| 347. | KHRLGINEPKK; |
| 348. | RHRLGINEPKK; |
| 349. | HHRLGINEPKK; |
| 350. | KKRLGINEPKK; |
| 351. | RKRLGINEPKK; |
| 352. | HKRLGINEPKK; |
| 353. | KRRLGINEPKK; |
| 354. | RRRLGINEPKK; |
| 355. | HRRLGINEPKK; |
| 356. | KHHIGIENPKK; |
| 357. | RHHIGINEPKK; |
| 358. | HHHIGINEPKK; |
| 359. | KKHIGINEPKK; |
| 360. | RKHIGINEPKK; |
| 361. | HKHIGINEPKK; |

TABLE 7-continued

SEQ ID NO. shown to left of sequence(cont'd)

| SEQ ID NO. | Sequence |
|---|---|
| 362. | KRHIGINEPKK; |
| 363. | RRHIGINEPKK; |
| 364. | HRHIGINEPKK; |
| 365. | KHKIGINEPKK; |
| 366. | RHKIGINEPKK; |
| 367. | HHKIGINEPKK; |
| 368. | KKKIGINEPKK; |
| 369. | RKKIGINEPKK; |
| 370. | HKKIGINEPKK; |
| 371. | KRKIGINEPKK; |
| 372. | RRKIGINEPKK; |
| 373. | HRKIGINEPKK; |
| 374. | KHRIGINEPKK; |
| 375. | RHRIGINEPKK; |
| 376. | HHRVGINEPKK; |
| 377. | KKRIGINEPKK; |
| 378. | RKRIGINEPKK; |
| 379. | HKRIGINEPKK; |
| 380. | KRRIGINEPKK; |
| 381. | RRRIGINEPKK; |
| 382. | HRRIGINEPKK; |
| 383. | KHHVGINEPKK; |
| 384. | RHHVGINEPKK; |
| 385. | HHHVGINEPKK; |
| 386. | KKHVGINEPKK; |
| 387. | RKHVGINEPKK; |
| 388. | HKHVGINEPKK; |
| 389. | KRHVGINEPKK; |
| 390. | RRHVGINEPKK; |
| 391. | HRHVGINEPKK; |
| 392. | KHKVGINEPKK; |
| 393. | RHKVGINEPKK; |
| 394. | HKKVGINEPKK; |
| 395. | KKKVGINEPKK; |
| 396. | RKKVGINEPKK; |
| 397. | HKKVGINEPKK; |
| 398. | KRKVGINEPKK; |
| 399. | RRKVGINEPKK; |
| 400. | HRKVGINEPKK; |
| 401. | KHRVGINEPKK; |
| 402. | RHRVGINEPKK; |
| 403. | HHRVGINEPKK; |
| 404. | KKRVGINEPKK; |
| 405. | RKRVGINEPKK; |
| 406. | HKRVGINEPKK; |
| 407. | KRRVGINEPKK; |
| 408. | RRRVGINEPKK; |
| 409. | HRRVGINEPKK; |
| 410. | KHHLGVNEPKK; |
| 411. | RHHLGVNEPKK; |
| 412. | HHHLGVNEPKK; |
| 413. | KKHLGVNEPKK; |
| 414. | RKHLGVNEPKK; |
| 415. | HKHLGVNEPKK; |
| 416. | KRHLGVNEPKK; |
| 417. | RRHLGVNEPKK; |
| 418. | HRHLGVNEPKK; |
| 419. | KHKLGVNEPKK; |
| 420. | RHKLGVNEPKK; |
| 421. | HHKLGVNEPKK; |
| 422. | KKKLGVNEPKK; |
| 423. | RKKLGVNEPKK; |
| 424. | HKKLGVNEPKK; |
| 425. | KRKLGVNEPKK; |
| 426. | RRKLGVNEPKK; |
| 427. | HRKLGVNEPKK; |
| 428. | KHRLGVNEPKK; |
| 429. | RHRLGVNEPKK; |
| 430. | HHRLGVNEPKK; |
| 431. | KKRLGVNEPKK; |
| 432. | RKRLGVNEPKK; |
| 433. | HKRLGVNEPKK; |
| 434. | KRRLGVNEPKK; |
| 435. | RRRLGVNEPKK; |
| 436. | HRRLGVNEPKK; |
| 437. | KHHIGVNEPKK; |
| 438. | RHHIGVNEPKK; |
| 439. | HHHIGVNEPKK; |

TABLE 7-continued

SEQ ID NO. shown to left of sequence(cont'd)

| SEQ ID NO. | Sequence |
|---|---|
| 440. | KKHIGVNEPKK; |
| 441. | RKHIGVNEPKK; |
| 442. | HKHIGVNEPKK; |
| 443. | KRHIGVNEPKK; |
| 444. | RRHIGVNEPKK; |
| 445. | HRHIGVNEPKK; |
| 446. | KHKIGVNEPKK; |
| 447. | RHKIGVNEPKK; |
| 448. | HHKIGVNEPKK; |
| 449. | KKKIGVNEPKK; |
| 450. | RKKIGVNEPKK; |
| 451. | HKKIGVNEPKK; |
| 452. | KRKIGVNEPKK; |
| 453. | RRKIGVNEPKK; |
| 454. | HRKIGVNEPKK; |
| 455. | KHRIGVNEPKK; |
| 456. | RHRIGVNEPKK; |
| 457. | HHRIGVNEPKK; |
| 458. | KKRIGVNEPKK; |
| 459. | RKRIGVNEPKK; |
| 460. | HKRIGVNEPKK; |
| 461. | KRRIGVNEPKK; |
| 462. | RRRIGVNEPKK; |
| 463. | HRRIGVNEPKK; |
| 464. | KHHVGVNEPKK; |
| 465. | RHHVGVNEPKK; |
| 466. | HHHVGVNEPKK; |
| 467. | KKHVGVNEPKK; |
| 468. | RKHVGVNEPKK; |
| 469. | HKHVGVNEPKK; |
| 470. | KRHVGVNEPKK; |
| 471. | RRHVGVNEPKK; |
| 472. | HRHVGVNEPKK; |
| 473. | KHKVGVNEPKK; |
| 474. | RHKVGVNEPKK; |
| 475. | HHKVGVNEPKK; |
| 476. | KKKVGVNEPKK; |
| 477. | RKKVGVNEPKK; |
| 478. | HKKVGVNEPKK; |
| 479. | KRKVGVNEPKK; |
| 480. | RRKVGVNEPKK; |
| 481. | HRKVGVNEPKK; |
| 482. | KHRVGVNEPKK; |
| 483. | RHRVGVNEPKK; |
| 484. | HHRVGVNEPKK; |
| 485. | KKRVGVNEPKK; |
| 486. | RKRVGVNEPKK; |
| 487. | HKRVGVNEPKK; |
| 488. | KRRVGVNEPKK; |
| 489. | RRRVGVNEPKK; |
| 490. | HRRVGVNEPKK; |
| 491. | KHHLGLENPKK; |
| 492. | RHHLGLENPKK; |
| 493. | HHHLGLENPKK; |
| 494. | KKHLGLENPKK; |
| 495. | RKHLGLENPKK; |
| 496. | HKHLGLENPKK; |
| 497. | KRHLGLENPKK; |
| 498. | RRHLGLENPKK; |
| 499. | HRHLGLENPKK; |
| 500. | KHKLGLENPKK; |
| 501. | RHKLGLENPKK; |
| 502. | HHKLGLENPKK; |
| 503. | KKKLGLENPKK; |
| 504. | RKKLGLENPKK; |
| 505. | HKKLGLENPKK; |
| 506. | KRKLGLENPKK; |
| 507. | RRKLGLENPKK; |
| 508. | HRKLGLENPKK; |
| 509. | KHRLGLENPKK; |
| 510. | RHRLGLENPKK; |
| 511. | HHRLGLENPKK; |
| 512. | KKRLGLENPKK; |
| 513. | RKRLGLENPKK; |
| 514. | HKRLGLENPKK; |
| 515. | KRRLGLENPKK; |
| 516. | RRRLGLENPKK; |
| 517. | HRRLGLENPKK; |

TABLE 7-continued

SEQ ID NO. shown to left of sequence (cont'd)

| SEQ ID NO. | Sequence |
|---|---|
| 518. | KHHIGLENPKK; |
| 519. | RHHIGLENPKK; |
| 520. | HHHIGLENPKK; |
| 521. | KKHIGLENPKK; |
| 522. | RKHIGLENPKK; |
| 523. | HKHIGLENPKK; |
| 524. | KRHIGLENPKK; |
| 525. | RRHIGLENPKK; |
| 526. | HRHIGLENPKK; |
| 527. | KHKIGLENPKK; |
| 528. | RHKIGLENPKK; |
| 529. | HHKIGLENPKK; |
| 530. | KKKIGLENPKK; |
| 531. | RKKIGLENPKK; |
| 532. | HKKIGLENPKK; |
| 533. | KRKIGLENPKK; |
| 534. | RRKIGLENPKK; |
| 535. | HRKIGLENPKK; |
| 536. | KHRIGLENPKK; |
| 537. | RHRIGLENPKK; |
| 538. | HHRIGLENPKK; |
| 539. | KKRIGLENPKK; |
| 540. | RKRIGLENPKK; |
| 541. | HKRIGLENPKK; |
| 542. | KRRIGLENPKK; |
| 543. | RRRIGLENPKK; |
| 544. | HRRIGLENPKK; |
| 545. | KHHVGLENPKK; |
| 546. | RHHVGLENPKK; |
| 547. | HHHVGLENPKK; |
| 548. | KKHVGLENPKK; |
| 549. | RKHVGLENPKK; |
| 550. | HKHVGLENPKK; |
| 551. | KRHVGLENPKK; |
| 552. | RRHVGLENPKK; |
| 553. | HRHVGLENPKK; |
| 554. | KHKVGLENPKK; |
| 555. | RHKVGLENPKK; |
| 556. | HHKVGLENPKK; |
| 557. | KKKVGLENPKK; |
| 558. | RKKVGLENPKK; |
| 559. | HKKVGLENPKK; |
| 560. | KRKVGLENPKK; |
| 561. | RRKVGLENPKK; |
| 562. | HRKVGLENPKK; |
| 563. | KHRVGLENPKK; |
| 564. | RHRVGLENPKK; |
| 565. | HHRVGLENPKK; |
| 566. | KKRVGLENPKK; |
| 567. | RKRVGLENPKK; |
| 568. | HKRVGLENPKK; |
| 569. | KRRVGLENPKK; |
| 570. | RRRVGLENPKK; |
| 571. | HRRVGLENPKK; |
| 572. | KHHLGIENPKK; |
| 573. | RHHLGIENPKK; |
| 574. | HHHLGIENPKK; |
| 575. | KKHLGIENPKK; |
| 576. | RKHLGIENPKK; |
| 577. | HKHLGIENPKK; |
| 578. | KRHLGIENPKK; |
| 579. | RRHLGIENPKK; |
| 580. | HRHLGIENPKK; |
| 581. | KHKLGIENPKK; |
| 582. | RHKLGIENPKK; |
| 583. | HHKLGIENPKK; |
| 584. | KKKLGIENPKK; |
| 585. | RKKLGIENPKK; |
| 586. | HKKLGIENPKK; |
| 587. | KRKLGIENPKK; |
| 588. | RRKLGIENPKK; |
| 589. | HRKLGIENPKK; |
| 590. | KHRLGIENPKK; |
| 591. | RHRLGIENPKK; |
| 592. | HHRLGIENPKK; |
| 593. | KKRLGIENPKK; |
| 594. | RKRLGIENPKK; |
| 595. | HKRLGIENPKK; |

TABLE 7-continued

| SEQ ID NO. | shown to left of sequence (cont'd) |
|---|---|
| 596. | KRRLGIENPKK; |
| 597. | RRRLGIENPKK; |
| 598. | HRRLGIENPKK; |
| 599. | KHHIGIENPKK; |
| 600. | RHHIGIENPKK; |
| 601. | HHHIGIENPKK; |
| 602. | KKHIGIENPKK; |
| 603. | RKHIGIENPKK; |
| 604. | HKHIGIENPKK; |
| 605. | KRHIGIENPKK; |
| 606. | RRHIGIENPKK; |
| 607. | HRHIGIENPKK; |
| 608. | KHKIGIENPKK; |
| 609. | RHKIGIENPKK; |
| 610. | HHKIGIENPKK; |
| 611. | KKKIGIENPKK; |
| 612. | RKKIGIENPKK; |
| 613. | HKKIGIENPKK; |
| 614. | KRKIGIENPKK; |
| 615. | RRKIGIENPKK; |
| 616. | HRKIGIENPKK; |
| 617. | KHRIGIENPKK; |
| 618. | RHRIGIENPKK; |
| 619. | HHRIGIENPKK; |
| 620. | KKRIGIENPKK; |
| 621. | RKRIGIENPKK; |
| 622. | HKRIGIENPKK; |
| 623. | KRRIGIENPKK; |
| 624. | RRRIGIENPKK; |
| 625. | HRRIGIENPKK; |
| 626. | KHHVGIENPKK; |
| 627. | RHHVGIENPKK; |
| 628. | HHHVGIENPKK; |
| 629. | KKHVGIENPKK; |
| 630. | RKHVGIENPKK; |
| 631. | HKHVGIENPKK; |
| 632. | KRHVGIENPKK; |
| 633. | RRHVGIENPKK; |
| 634. | HRHVGIENPKK; |
| 635. | KHKVGIENPKK; |
| 636. | RHKVGIENPKK; |
| 637. | HHKVGIENPKK; |
| 638. | KKKVGIENPKK; |
| 639. | RKKVGIENPKK; |
| 640. | HKKVGIENPKK; |
| 641. | KRKVGIENPKK; |
| 642. | RRKVGIENPKK; |
| 643. | HRKVGIENPKK; |
| 644. | KHRVGIENPKK; |
| 645. | RHRVGIENPKK; |
| 646. | HHRVGIENPKK; |
| 647. | KKRVGIENPKK; |
| 648. | RKRVGIENPKK; |
| 649. | HKRVGIENPKK; |
| 650. | KRRVGIENPKK; |
| 651. | RRRVGIENPKK; |
| 652. | HRRVGIENPKK; |
| 653. | KHHLGVENPKK; |
| 654. | RHHLGVENPKK; |
| 655. | HHHLGVENPKK; |
| 656. | KKHLGVENPKK; |
| 657. | RKHLGVENPKK; |
| 658. | HKHLGVENPKK; |
| 659. | KRHLGVENPKK; |
| 660. | RRHLGVENPKK; |
| 661. | HRHLGVENPKK; |
| 662. | KHKLGVENPKK; |
| 663. | RHKLGVENPKK; |
| 664. | HHKLGVENPKK; |
| 665. | KKKLGVENPKK; |
| 666. | RKKLGVENPKK; |
| 667. | HKKLGVENPKK; |
| 668. | KRKLGVENPKK; |
| 669. | RRKLGVENPKK; |
| 670. | HRKLGVENPKK; |
| 671. | KHRLGVENPKK; |
| 672. | RHRLGVENPKK; |
| 673. | HHRLGVENPKK; |

TABLE 7-continued

SEQ ID NO. shown to left of sequence(cont'd)

| SEQ ID NO. | Sequence |
|---|---|
| 674. | KKRLGVENPKK; |
| 675. | RKRLGVENPKK; |
| 676. | HKRLGVENPKK; |
| 677. | KRRLGVENPKK; |
| 678. | RRRLGVENPKK; |
| 679. | HRRLGVENPKK; |
| 680. | KHHIGVENPKK; |
| 681. | RHHIGVEEPKK; |
| 682. | HHHIGVENPKK; |
| 683. | KKHIGVENPKK; |
| 684. | RKHIGVENPKK; |
| 685. | HKHIGVENPKK; |
| 686. | KRHIGVENPKK; |
| 687. | RRHIGVENPKK; |
| 688. | HRHIGVENPKK; |
| 689. | KHKIGVENPKK; |
| 690. | RHKIGVENPKK; |
| 691. | HHKIGVENPKK; |
| 692. | KKKIGVENPKK; |
| 693. | RKKIGVENPKK; |
| 694. | HKKIGVENPKK; |
| 695. | KRKIGVENPKK; |
| 696. | RRKIGVENPKK; |
| 697. | HRKIGVENPKK; |
| 698. | KHRIGVENPKK; |
| 699. | RHRIGVENPKK; |
| 700. | HHRIGVENPKK; |
| 701. | KKRIGVENPKK; |
| 702. | RKRIGVENPKK; |
| 703. | HKRIGVENPKK; |
| 704. | KRRIGVENPKK; |
| 705. | RRRIGVENPKK; |
| 706. | HRRIGVENPKK; |
| 707. | KHHVGVENPKK; |
| 708. | RHHVGVENPKK; |
| 709. | HHHVGVENPKK; |
| 710. | KKHVGVENPKK; |
| 711. | RKHVGVENPKK; |
| 712. | HKHVGVENPKK; |
| 713. | KRHVGVENPKK; |
| 714. | RRHVGVENPKK; |
| 715. | HRHVGVENPKK; |
| 716. | KHKVGVENPKK; |
| 717. | RHKVGVENPKK; |
| 718. | HHKVGVENPKK; |
| 719. | KKKVGVENPKK; |
| 720. | RKKVGVENPKK; |
| 721. | HKKVGVENPKK; |
| 722. | KRKVGVENPKK; |
| 723. | RRKVGVEEPKK; |
| 724. | HRKVGVENPKK; |
| 725. | KHRVGVENPKK; |
| 726. | RHRVGVENPKK; |
| 727. | HHRVGVENPKK; |
| 728. | KKRVGVENPKK; |
| 729. | RKRVGVENPKK; |
| 730. | HKRVGVENPKK; |
| 731. | KRRVGVENPKK; |
| 732. | RRRVGVENPKK; |
| 733. | HRRVGVENPKK; |
| 734. | KHHLGLNNPKK; |
| 735. | RHHLGLNNPKK; |
| 736. | HHHLGLNNPKK; |
| 737. | KKHLGLNNPKK; |
| 738. | RKHLGLNNPKK; |
| 739. | HKHLGLNNPKK; |
| 740. | KRHLGLNNPKK; |
| 741. | RRHLGLNNPKK; |
| 742. | HRHLGLNNPKK; |
| 743. | KHKLGLNNPKK; |
| 744. | RHKLGLNNPKK; |
| 745. | HHKLGLNNPKK; |
| 746. | KKKLGLNNPKK; |
| 747. | RKKLGLNNPKK; |
| 748. | HKKLGLNNPKK; |
| 749. | KRKLGLNNPKK; |
| 750. | RRKLGLNNPKK; |
| 751. | HRKLGLNNPKK; |

TABLE 7-continued

SEQ ID NO. shown to left of sequence(cont'd)

| SEQ ID NO. | Sequence |
|---|---|
| 752. | KHRLGLNNPKK; |
| 753. | RHRLGLNNPKK; |
| 754. | HHRLGLNNPKK; |
| 755. | KKRLGLNNPKK; |
| 756. | RKRLGLNNPKK; |
| 757. | HKRLGLNNPKK; |
| 758. | KRRLGLNNPKK; |
| 759. | RRRLGLNNPKK; |
| 760. | HRRLGLNNPKK; |
| 761. | KHHIGLNNPKK; |
| 762. | RHHIGLNNPKK; |
| 763. | HHHIGLNNPKK; |
| 764. | KKHIGLNNPKK; |
| 765. | RKHIGLNNPKK; |
| 766. | HKHIGLNNPKK; |
| 767. | KRHIGLNNPKK; |
| 768. | RRHIGLNNPKK; |
| 769. | HRHIGLNNPKK; |
| 770. | KHKIGLNNPKK; |
| 771. | RHKIGLNNPKK; |
| 772. | HHKIGLNNPKK; |
| 773. | KKKIGLNNPKK; |
| 774. | RKKIGLNNPKK; |
| 775. | HKKIGLNNPKK; |
| 776. | KRKIGLNNPKK; |
| 777. | RRKIGLNNPKK; |
| 778. | HRKIGLNNPKK; |
| 779. | KHRIGLNNPKK; |
| 780. | RHRIGLNNPKK; |
| 781. | HHRIGLNNPKK; |
| 782. | KKRIGLNNPKK; |
| 783. | RKRIGLNNPKK; |
| 784. | HKRIGLNNPKK; |
| 785. | KRRIGLNNPKK; |
| 786. | RRRIGLNNPKK; |
| 787. | HRRIGLNNPKK; |
| 788. | KHHVGLNNPKK; |
| 789. | RHHVGLNNPKK; |
| 790. | HHHVGLNNPKK; |
| 791. | KKHVGLNNPKK; |
| 792. | RKHVGLNNPKK; |
| 793. | HKHVGLNNPKK; |
| 794. | KRHVGLNNPKK; |
| 795. | RRHVGLNNPKK; |
| 796. | HRHVGLNNPKK; |
| 797. | KHKVGLNNPKK; |
| 798. | RHKVGLNNPKK; |
| 799. | HHKVGLNNPKK; |
| 800. | KKKVGLNNPKK; |
| 801. | RKKVGLNNPKK; |
| 802. | HKKVGLNNPKK; |
| 803. | KRKVGLNNPKK; |
| 804. | RRKVGLNNPKK; |
| 805. | HRKVGLNNPKK; |
| 806. | KHRVGLNNPKK; |
| 807. | RHRVGLNNPKK; |
| 808. | HHRVGLNNPKK; |
| 809. | KKRVGLNNPKK; |
| 810. | RKRVGLNNPKK; |
| 811. | HKRVGLNNPKK; |
| 812. | KRRVGLNNPKK; |
| 813. | RRRVGLNNPKK; |
| 814. | HRRVGLNNPKK; |
| 815. | KHHLGINNPKK; |
| 816. | RHHLGINNPKK; |
| 817. | HHHLGINNPKK; |
| 818. | KKHLGINNPKK; |
| 819. | RKHLGINNPKK; |
| 820. | HKHLGINNPKK; |
| 821. | KRHLGINNPKK; |
| 822. | RRHLGINNPKK; |
| 823. | HRHLGINNPKK; |
| 824. | KHKLGINNPKK; |
| 825. | RHKLGINNPKK; |
| 826. | HHKLGINNPKK; |
| 827. | KKKLGINNPKK; |
| 828. | RKKLGINNPKK; |
| 829. | HKKLGINNPKK; |

TABLE 7-continued

SEQ ID NO. shown to left of sequence (cont'd)

| SEQ ID NO. | Sequence |
|---|---|
| 830. | KRKLGINNPKK; |
| 831. | RRKLGINNPKK; |
| 832. | HRKLGINNPKK; |
| 833. | KHRLGINNPKK; |
| 834. | RHRLGINNPKK; |
| 835. | HHRLGLNNPKK; |
| 836. | KKRLGINNPKK; |
| 837. | RKRLGINNPKK; |
| 838. | HKRLGINNPKK; |
| 839. | KRRLGINNPKK; |
| 840. | RRRLGINNPKK; |
| 841. | HRRLGINNPKK; |
| 842. | KHHIGIENPKK; |
| 843. | RHHIGINNPKK; |
| 844. | HHHIGINNPKK; |
| 845. | KKHIGINNPKK; |
| 846. | RKHIGINNPKK; |
| 847. | HKHIGINNPKK; |
| 848. | KRHIGINNPKK; |
| 849. | RRHIGINNPKK; |
| 850. | HRHIGINNPKK; |
| 851. | KHKIGINNPKK; |
| 852. | RHKIGINNPKK; |
| 853. | HHKIGINNPKK; |
| 854. | KKKIGINNPKK; |
| 855. | RKKIGINNPKK; |
| 856. | HKKIGINNPKK; |
| 857. | KRKIGINNPKK; |
| 858. | RRKIGINNPKK; |
| 859. | HRKIGINNPKK; |
| 860. | KHRIGINNPKK; |
| 861. | RHRIGINNPKK; |
| 862. | HHRIGINNPKK; |
| 863. | KKRIGINNPKK; |
| 864. | RKRIGINNPKK; |
| 865. | HKRIGINNPKK; |
| 866. | KRRIGINNPKK; |
| 867. | RRRIGINNPKK; |
| 868. | HRRIGINNPKK; |
| 869. | KHHVGINNPKK; |
| 870. | RHHVGINNPKK; |
| 871. | HHHVGINNPKK; |
| 872. | KKHVGINNPKK; |
| 873. | RKHVGINNPKK; |
| 874. | HKHVGINNPKK; |
| 875. | KRHVGINNPKK; |
| 876. | RRHVGINNPKK; |
| 877. | HRHVGINNPKK; |
| 878. | KHKVGINNPKK; |
| 879. | RHKVGINNPKK; |
| 880. | HHKVGINNPKK; |
| 881. | KKKVGINNPKK; |
| 882. | RKKVGINNPKK; |
| 883. | HKKVGINNPKK; |
| 884. | KRKVGINNPKK; |
| 885. | RRKVGINNPKK; |
| 886. | HRKVGINNPKK; |
| 887. | KHRVGINNPKK; |
| 888. | RHRVGINNPKK; |
| 889. | HHRVGINNPKK; |
| 890. | KKRVGINNPKK; |
| 891. | RKRVGINNPKK; |
| 892. | HKRVGINNPKK; |
| 893. | KRRVGINNPKK; |
| 894. | RRRVGINNPKK; |
| 895. | HRRVGINNPKK; |
| 896. | KHHLGVNNPKK; |
| 897. | RHHLGVNNPKK; |
| 898. | HHHLGVNNPKK; |
| 899. | KKHLGVNNPKK; |
| 900. | RKHLGVNNPKK; |
| 901. | HKHLGVNNPKK; |
| 902. | KRHLGVNNPKK; |
| 903. | RRHLGVNNPKK; |
| 904. | HRHLGVNNPKK; |
| 905. | KHKLGVNNPKK; |
| 906. | RHKLGVNNPKK; |
| 907. | HHKLGVNNPKK; |

TABLE 7-continued

SEQ ID NO. shown to left of sequence(cont'd)

| | |
|---|---|
| 908. | KKKLGVNNPKK; |
| 909. | RKKLGVNNPKK; |
| 910. | HKKLGVNNPKK; |
| 911. | KRKLGVNNPKK; |
| 912. | RRKLGVNNPKK; |
| 913. | HRKLGVNNPKK; |
| 914. | KHRLGVNNPKK; |
| 915. | RHRLGVNNPKK; |
| 916. | HHRLGVNNPKK; |
| 917. | KKRLGVNNPKK; |
| 918. | RKRLGVNNPKK; |
| 919. | HKRLGVNNPKK; |
| 920. | KRRLGVNNPKK; |
| 921. | RRRLGVNNPKK; |
| 922. | HRRLGVNNPKK; |
| 923. | KHHIGVNNPKK; |
| 924. | RHHIGVNNPKK; |
| 925. | HHHIGVNNPKK; |
| 926. | KKHIGVNNPKK; |
| 927. | RKHIGVNNPKK; |
| 928. | HKHIGVNNPKK; |
| 929. | KRHIGVNNPKK; |
| 930. | RRHIGVNNPKK; |
| 931. | HRHIGVNNPKK; |
| 932. | KHKIGVNNPKK; |
| 933. | RHKIGVNNPKK; |
| 934. | HHKIGVNNPKK; |
| 935. | KKKIGVNNPKK; |
| 936. | RKKIGVNNPKK; |
| 937. | HKKIGVNNPKK; |
| 938. | KRKIGVNNPKK; |
| 939. | RRKIGVNNPKK; |
| 940. | HRKIGVNNPKK; |
| 941. | KHRIGVNNPKK; |
| 942. | RHRIGVNNPKK; |
| 943. | HHRIGVNNPKK; |
| 944. | KKRIGVNNPKK; |
| 945. | RKRIGVNNPKK; |
| 946. | HKRIGVNNPKK; |

TABLE 7-continued

SEQ ID NO. shown to left of sequence(cont'd)

| | |
|---|---|
| 947. | KRRIGVNNPKK; |
| 948. | RRRIGVNNPKK; |
| 949. | HRRIGVNNPKK; |
| 950. | KHHVGVNNPKK; |
| 951. | RHHVGVNNPKK; |
| 952. | HHHVGVNNPKK; |
| 953. | KKHVGVNNPKK; |
| 954. | RKHVGVNNPKK; |
| 955. | HKHVGVNNPKK; |
| 956. | KRHVGVNNPKK; |
| 957. | RRHVGVNNPKK; |
| 958. | HRHVGVNNPKK; |
| 959. | KHKVGVNNPKK; |
| 960. | RHKVGVNNPKK; |
| 961. | HHKVGVNNPKK; |
| 962. | KKKVGVNNPKK; |
| 963. | RKKVGVNNPKK; |
| 964. | HKKVGVNNPKK; |
| 965. | KRKVGVNNPKK; |
| 966. | RRKVGVNNPKK; |
| 967. | HRKVGVNNPKK; |
| 968. | KHRVGVNNPKK; |
| 969. | RHRVGVNNPKK; |
| 970. | HHRVGVNNPKK; |
| 971. | KKRVGVNNPKK; |
| 972. | RKRVGVNNPKK; |
| 973. | HKRVGVNNPKK; |
| 974. | KRRVGVNNPKK; |
| 975. | RRRVGVNNPKK; |
| 976. | HRRVGVNNPKK; |
| 977. | KHHLGLEEPKR; |
| 978. | RHHLGLEEPKR; |
| 979. | HHHLGLEEPKR; |
| 980. | KKHLGLEEPKR; |
| 981. | RKHLGLEEPKR; |
| 982. | HKHLGLEEPKR; |
| 983. | KRHLGLEEPKR; |
| 984. | RRHLGLEEPKR; |
| 985. | HRHLGLEEPKR; |

TABLE 7-continued

SEQ ID NO. shown to left of sequence (cont'd)

| SEQ ID NO. | Sequence |
|---|---|
| 986. | KHKLGLEEPKR; |
| 987. | RHKLGLEEPKR; |
| 988. | HHKLGLEEPKR; |
| 989. | KKKLGLEEPKR; |
| 990. | RKKLGLEEPKR; |
| 991. | HKKLGLEEPKR; |
| 992. | KRKLGLEEPKR; |
| 993. | RRKLGLEEPKR; |
| 994. | HRKLGLEEPKR; |
| 995. | KHRLGLEEPKR; |
| 996. | RHRLGLEEPKR; |
| 997. | HHRLGLEEPKR; |
| 998. | KKRLGLEEPKR; |
| 999. | RKRLGLEEPKR; |
| 1000. | HKRLGLEEPKR; |
| 1001. | KRRLGLEEPKR; |
| 1002. | RRRLGLEEPKR; |
| 1003. | HRRLGLEEPKR; |
| 1004. | KHHIGLEEPKR; |
| 1005. | RHHIGLEEPKR; |
| 1006. | HHHIGLEEPKR; |
| 1007. | KKHIGLEEPKR; |
| 1008. | RKHIGLEEPKR; |
| 1009. | HKHIGLEEPKR; |
| 1010. | KRHIGLEEPKR; |
| 1011. | RRHIGLEEPKR; |
| 1012. | HRHIGLEEPKR; |
| 1013. | KHKIGLEEPKR; |
| 1014. | RHKIGLEEPKR; |
| 1015. | HHKIGLEEPKR; |
| 1016. | KKKIGLEEPKR; |
| 1017. | RKKIGLEEPKR; |
| 1018. | HKKIGLEEPKR; |
| 1019. | KRKIGLEEPKR; |
| 1020. | RRKIGLEEPKR; |
| 1021. | HRKIGLEEPKR; |
| 1022. | KHRIGLEEPKR; |
| 1023. | RHRIGLEEPKR; |
| 1024. | HHRIGLEEPKR; |
| 1025. | KKRIGLEEPKR; |
| 1026. | RKRIGLEEPKR; |
| 1027. | HKRIGLEEPKR; |
| 1028. | KRRIGLEEPKR; |
| 1029. | RRRIGLEEPKR; |
| 1030. | HRRIGLEEPKR; |
| 1031. | KHHVGLEEPKR; |
| 1032. | RHHVGLEEPKR; |
| 1033. | HHHVGLEEPKR; |
| 1034. | KKHVGLEEPKR; |
| 1035. | RKHVGLEEPKR; |
| 1036. | HKHVGLEEPKR; |
| 1037. | KRHVGLEEPKR; |
| 1038. | RRHVGLEEPKR; |
| 1039. | HRHVGLEEPKR; |
| 1040. | KHKVGLEEPKR; |
| 1041. | RHKVGLEEPKR; |
| 1042. | HHKVGLEEPKR; |
| 1043. | KKKVGLEEPKR; |
| 1044. | RKKVGLEEPKR; |
| 1045. | HKKVGLEEPKR; |
| 1046. | KRKVGLEEPKR; |
| 1047. | RRKVGLEEPKR; |
| 1048. | HRKVGLEEPKR; |
| 1049. | KHRVGLEEPKR; |
| 1050. | RHRVGLEEPKR; |
| 1051. | HHRVGLEEPKR; |
| 1052. | KKRVGLEEPKR; |
| 1053. | RKRVGLEEPKR; |
| 1054. | HKRVGLEEPKR; |
| 1055. | KRRVGLEEPKR; |
| 1056. | RRRVGLEEPKR; |
| 1057. | HRRVGLEEPKR; |
| 1058. | KHHLGIEEPKR; |
| 1059. | RHHLGIEEPKR; |
| 1060. | HHHLGIEEPKR; |
| 1061. | KKHLGIEEPKR; |
| 1062. | RKHLGIEEPKR; |
| 1063. | HKHLGIEEPKR; |

TABLE 7-continued

SEQ ID NO. shown to left of sequence(cont'd)

| SEQ ID NO. | Sequence |
|---|---|
| 1064. | KRHLGIEEPKR; |
| 1065. | RRHLGIEEPKR; |
| 1066. | HRHLGIEEPKR; |
| 1067. | KHKLGIEEPKR; |
| 1068. | RHKLGIEEPKR; |
| 1069. | HHKLGIEEPKR; |
| 1070. | KKKLGIEEPKR; |
| 1071. | RKKLGIEEPKR; |
| 1072. | HKKLGIEEPKR; |
| 1073. | KRKLGIEEPKR; |
| 1074. | RRKLGIEEPKR; |
| 1075. | HRKLGIEEPKR; |
| 1076. | KHRLGIEEPKR; |
| 1077. | RHRLGIEEPKR; |
| 1078. | HHRLGIEEPKR; |
| 1079. | KKRLGIEEPKR; |
| 1080. | RKRLGIEEPKR; |
| 1081. | HKRLGIEEPKR; |
| 1082. | KRRLGIEEPKR; |
| 1083. | RRRLGIEEPKR; |
| 1084. | HRRLGIEEPKR; |
| 1085. | KHHIGIEEPKR; |
| 1086. | RHHIGIEEPKR; |
| 1087. | HHHIGIEEPKR; |
| 1088. | KKHIGIEEPKR; |
| 1089. | RKHIGIEEPKR; |
| 1090. | HKHIGIEEPKR; |
| 1091. | KRHIGIEEPKR; |
| 1092. | RRHIGIEEPKR; |
| 1093. | HRHIGIEEPKR; |
| 1094. | KHKIGIEEPKR; |
| 1095. | RHKIGIEEPKR; |
| 1096. | HHKIGIEEPKR; |
| 1097. | KKKIGIEEPKR; |
| 1098. | RKKIGIEEPKR; |
| 1099. | HKKIGIEEPKR; |
| 1100. | KRKIGIEEPKR; |
| 1101. | RRKIGIEEPKR; |
| 1102. | HRKIGIEEPKR; |
| 1103. | KHRIGIEEPKR; |
| 1104. | RHRIGIEEPKR; |
| 1105. | HHRIGIEEPKR; |
| 1106. | KKRIGIEEPKR; |
| 1107. | RKRIGIEEPKR; |
| 1108. | HKRIGIEEPKR; |
| 1109. | KRRIGIEEPKR; |
| 1110. | RRRIGIEEPKR; |
| 1111. | HRRIGIEEPKR; |
| 1112. | KHHVGIEEPKR; |
| 1113. | RHHVGIEEPKR; |
| 1114. | HHHVGIEEPKR; |
| 1115. | KKHVGIEEPKR; |
| 1116. | RKHVGIEEPKR; |
| 1117. | HKHVGIEEPKR; |
| 1118. | KRHVGIEEPKR; |
| 1119. | RRHVGIEEPKR; |
| 1120. | HRHVGIEEPKR; |
| 1121. | KHKVGIEEPKR; |
| 1122. | RHKVGIEEPKR; |
| 1123. | HHKVGIEEPKR; |
| 1124. | KKKVGIEEPKR; |
| 1125. | RKKVGIEEPKR; |
| 1126. | HKKVGIEEPKR; |
| 1127. | KRKVGIEEPKR; |
| 1128. | RRKVGIEEPKR; |
| 1129. | HRKVGIEEPKR; |
| 1130. | KHRVGIEEPKR; |
| 1131. | RHRVGIEEPKR; |
| 1132. | HHRVGIEEPKR; |
| 1133. | KKRVGIEEPKR; |
| 1134. | RKRVGIEEPKR; |
| 1135. | HKRVGIEEPKR; |
| 1136. | KRRVGIEEPKR; |
| 1137. | RRRVGIEEPKR; |
| 1138. | HRRVGIEEPKR; |
| 1139. | KHHLGVEEPKR; |
| 1140. | RHHLGVEEPKR; |
| 1141. | HHHLGVEEPKR; |

TABLE 7-continued

SEQ ID NO. shown to left of sequence(cont'd)

| | |
|---|---|
| 1142. | KKHLGVEEPKR; |
| 1143. | RKHLGVEEPKR; |
| 1144. | HKHLGVEEPKR; |
| 1145. | KRHLGVEEPKR; |
| 1146. | RRHLGVEEPKR; |
| 1147. | HRHLGVEEPKR; |
| 1148. | KHKLGVEEPKR; |
| 1149. | RHKLGVEEPKR; |
| 1150. | HHKLGVEEPKR; |
| 1151. | KKKLGVEEPKR; |
| 1152. | RKKLGVEEPKR; |
| 1153. | HKKLGVEEPKR; |
| 1154. | KRKLGVEEPKR; |
| 1155. | RRKLGVEEPKR; |
| 1156. | HRKLGVEEPKR; |
| 1157. | KHRLGVEEPKR; |
| 1158. | RHRLGVEEPKR; |
| 1159. | HHRLGVEEPKR; |
| 1160. | KKRLGVEEPKR; |
| 1161. | RKRLGVEEPKR; |
| 1162. | HKRLGVEEPKR; |
| 1163. | KRRLGVEEPKR; |
| 1164. | RRRLGVEEPKR; |
| 1165. | HRRLGVEEPKR; |
| 1166. | KHHIGVEEPKR; |
| 1167. | RHHIGVEEPKR; |
| 1168. | HHHIGVEEPKR; |
| 1169. | KKHIGVEEPKR; |
| 1170. | RKHIGVEEPKR; |
| 1171. | HKHIGVEEPKR; |
| 1172. | KRHIGVEEPKR; |
| 1173. | RRHIGVEEPKR; |
| 1174. | HRHIGVEEPKR; |
| 1175. | KHKIGVEEPKR; |
| 1176. | RHKIGVEEPKR; |
| 1177. | HHKIGVEEPKR; |
| 1178. | KKKIGVEEPKR; |
| 1179. | RKKIGVEEPKR; |
| 1180. | HKKIGVEEPKR; |
| 1181. | KRKIGVEEPKR; |
| 1182. | RRKIGVEEPKR; |
| 1183. | HRKIGVEEPKR; |
| 1184. | KHRIGVEEPKR; |
| 1185. | RHRIGVEEPKR; |
| 1186. | HHRIGVEEPKR; |
| 1187. | KKRIGVEEPKR; |
| 1188. | RKRIGVEEPKR; |
| 1189. | HKRIGVEEPKR; |
| 1190. | KRRIGVEEPKR; |
| 1191. | RRRIGVEEPKR; |
| 1192. | HRRIGVEEPKR; |
| 1193. | KHHVGVEEPKR; |
| 1194. | RHHVGVEEPKR; |
| 1195. | HHHVGVEEPKR; |
| 1196. | KKHVGVEEPKR; |
| 1197. | RKHVGVEEPKR; |
| 1198. | HKHVGVEEPKR; |
| 1199. | KRHVGVEEPKR; |
| 1200. | RRHVGVEEPKR; |
| 1201. | HRHVGVEEPKR; |
| 1202. | KHKVGVEEPKR; |
| 1203. | RHKVGVEEPKR; |
| 1204. | HHKVGVEEPKR; |
| 1205. | KKKVGVEEPKR; |
| 1206. | RKKVGVEEPKR; |
| 1207. | HKKVGVEEPKR; |
| 1208. | KRKVGVEEPKR; |
| 1209. | RRKVGVEEPKR; |
| 1210. | HRKVGVEEPKR; |
| 1211. | KHRVGVEEPKR; |
| 1212. | RHRVGVEEPKR; |
| 1213. | HHRVGVEEPKR; |
| 1214. | KKRVGVEEPKR; |
| 1215. | RKRVGVEEPKR; |
| 1216. | HKRVGVEEPKR; |
| 1217. | KRRVGVEEPKR; |
| 1218. | RRRVGVEEPKR; |
| 1219. | HRRVGVEEPKR; |

TABLE 7-continued

SEQ ID NO. shown to left of sequence(cont'd)

| | |
|---|---|
| 1220. | KHHLGLNEPKR; |
| 1221. | RHHLGLNEPKR; |
| 1222. | HHHLGLNEPKR; |
| 1223. | KKHLGLNEPKR; |
| 1224. | RKHLGLNEPKR; |
| 1225. | HKHLGLNEPKR; |
| 1226. | KRHLGLNEPKR; |
| 1227. | RRHLGLNEPKR; |
| 1228. | HRHLGLNEPKR; |
| 1229. | KHKLGLNEPKR; |
| 1230. | RHKLGLNEPKR; |
| 1231. | HHKLGLNEPKR; |
| 1232. | KKKLGLNEPKR; |
| 1233. | RKKLGLNEPKR; |
| 1234. | HKKLGLNEPKR; |
| 1235. | KRKLGLNEPKR; |
| 1236. | RRKLGLNEPKR; |
| 1237. | HRKLGLNEPKR; |
| 1238. | KHRLGLNEPKR; |
| 1239. | RHRLGLNEPKR; |
| 1240. | HHRLGLNEPKR; |
| 1241. | KKRLGLNEPKR; |
| 1242. | RKRLGLNEPKR; |
| 1243. | HKRLGLNEPKR; |
| 1244. | KRRLGLNEPKR; |
| 1245. | RRRLGLNEPKR; |
| 1246. | HRRLGLNEPKR; |
| 1247. | KHHIGLNPKR; |
| 1248. | RHHIGLNEPKR; |
| 1249. | HHHIGLNEPKR; |
| 1250. | KKHIGLNEPKR; |
| 1251. | RKHIGLNEPKR; |
| 1252. | HKHIGLNEPKR; |
| 1253. | KRHIGLNEPKR; |
| 1254. | RRHIGLNEPKR; |
| 1255. | HRHIGLNEPKR; |
| 1256. | KHKIGLNEPKR; |
| 1257. | RHKIGLNEPKR; |
| 1258. | HHKIGLNEPKR; |

TABLE 7-continued

SEQ ID NO. shown to left of sequence(cont'd)

| | |
|---|---|
| 1259. | KKKIGLNEPKR; |
| 1260. | RKKIGLNEPKR; |
| 1261. | HKKIGLNEPKR; |
| 1262. | KRKIGLNEPKR; |
| 1263. | RRKIGLNEPKR; |
| 1264. | HRKIGLNEPKR; |
| 1265. | KHRIGLNEPKR; |
| 1266. | RHRIGLNEPKR; |
| 1267. | HHRIGLNEPKR; |
| 1268. | KKRIGLNEPKR; |
| 1269. | RKRIGLNEPKR; |
| 1270. | HKRIGLNEPKR; |
| 1271. | KRRIGLNEPKR; |
| 1272. | RRRIGLNEPKR; |
| 1273. | HRRIGLNEPKR; |
| 1274. | KHHVGLNEPKR; |
| 1275. | RHHVGLNEPKR; |
| 1276. | HHHVGLNEPKR; |
| 1277. | KKHVGLNEPKR; |
| 1278. | RKHVGLNEPKR; |
| 1279. | HKHVGLNEPKR; |
| 1280. | KRHVGLNEPKR; |
| 1281. | RRHVGLNEPKR; |
| 1282. | HRHVGLNEPKR; |
| 1283. | KHKVGLNEPKR; |
| 1284. | RHKVGLNEPKR; |
| 1285. | HHKVGLNEPKR; |
| 1286. | KKKVGLNEPKR; |
| 1287. | RKKVGLNEPKR; |
| 1288. | HKKVGLNEPKR; |
| 1289. | KRKVGLNEPKR; |
| 1290. | RRKVGLNEPKR; |
| 1291. | HRKVGLNEPKR; |
| 1292. | KHRVGLNEPKR; |
| 1293. | RHRVGLNEPKR; |
| 1294. | HHRVGLNEPKR; |
| 1295. | KKRVGLNEPKR; |
| 1296. | RKRVGLNEPKR; |
| 1297. | HKRVGLNEPKR; |

TABLE 7-continued

SEQ ID NO. shown to left of sequence(cont'd)

| | |
|---|---|
| 1298. | KRRVGLNEPKR; |
| 1299. | RRRVGLNEPKR; |
| 1300. | HRRVGLNEPKR; |
| 1301. | KHHLGINEPKR; |
| 1302. | RHHLGINEPKR; |
| 1303. | HHHLGINEPKR; |
| 1304. | KKHLGINEPKR; |
| 1305. | RKHLGINEPKR; |
| 1306. | HKHLGINEPKR; |
| 1307. | KRHLGINEPKR; |
| 1308. | RRHLGINEPKR; |
| 1309. | HRHLGINEPKR; |
| 1310. | KHKLGINEPKR; |
| 1311. | RHKLGINEPKR; |
| 1312. | HHKLGINEPKR; |
| 1313. | KKKLGINEPKR; |
| 1314. | RKKLGINEPKR; |
| 1315. | HKKLGINEPKR; |
| 1316. | KRKLGINEPKR; |
| 1317. | RRKLGINEPKR; |
| 1318. | HRKLG1NEPKR; |
| 1319. | KHRLGINEPKR; |
| 1320. | RHRLGINEPKR; |
| 1321. | HHRLGINEPKR; |
| 1322. | KKRLGINEPKR; |
| 1323. | RKRLGINEPKR; |
| 1324. | HKRLGINEPKR; |
| 1325. | KRRLGINEPKR; |
| 1326. | RRRLGINEPKR; |
| 1327. | HRRLGINEPKR; |
| 1328. | KHHIGIENPKR; |
| 1329. | RHHIGINEPKR; |
| 1330. | HHHIGINEPKR; |
| 1331. | KKHIGINEPKR; |
| 1332. | RKHIGINEPKR; |
| 1333. | HKHIGINEPKR; |
| 1334. | KRHIGINEPKR; |
| 1335. | RRHIGINEPKR; |
| 1336. | HRHIGINEPKR; |
| 1337. | KHKIGINEPKR; |
| 1338. | RHKIGINEPKR; |
| 1339. | HHKIGINEPKR; |
| 1340. | KKKIGINEPKR; |
| 1341. | RKKIGINEPKR; |
| 1342. | HKKIGINEPKR; |
| 1343. | KRKIGINEPKR; |
| 1344. | RRKIGINEPKR; |
| 1345. | HRKIGINEPKR; |
| 1346. | KHRIGINEPKR; |
| 1347. | RHRIGINEPKR; |
| 1348. | HHRIGINEPKR; |
| 1349. | KKRIGINEPKR; |
| 1350. | RKRIGINEPKR; |
| 1351. | HKRIGINEPKR; |
| 1352. | KRRIGINEPKR; |
| 1353. | RRRIGINEPKR; |
| 1354. | HRRIGINEPKR; |
| 1355. | KHHVGINEPKR; |
| 1356. | RHHVGINEPKR; |
| 1357. | HHHVGINEPKR; |
| 1358. | KKHVGINEPKR; |
| 1359. | RKHVGINEPKR; |
| 1360. | HKHVGINEPKR; |
| 1361. | KRHVGINEPKR; |
| 1362. | RRHVGINEPKR; |
| 1363. | HRHVGINEPKR; |
| 1364. | KHKVGINEPKR; |
| 1365. | RHKVGINEPKR; |
| 1366. | HHKVGINEPKR; |
| 1367. | KKKVGINEPKR; |
| 1368. | RKKVGINEPKR; |
| 1369. | HKKVGINEPKR; |
| 1370. | KRKVGINEPKR; |
| 1371. | RRKVGINEPKR; |
| 1372. | HRKVGINEPKR; |
| 1373. | KHRVGINEPKR; |
| 1374. | RHRVGINEPKR; |
| 1375. | HHRVGINEPKR; |

TABLE 7-continued

SEQ ID NO. shown to left of sequence(cont'd)

| | |
|---|---|
| 1376. | KKRVGINEPKR; |
| 1377. | RKRVGINEPKR; |
| 1378. | HKRVGINEPKR; |
| 1379. | KRRVGINEPKR; |
| 1380. | RRRVGINEPKR; |
| 1381. | HRRVGINEPKR; |
| 1382. | KHHLGVNEPKR; |
| 1383. | RHHLGVNEPKR; |
| 1384. | HHHLGVNEPKR; |
| 1385. | KKHLGVNEPKR; |
| 1386. | RKHLGVNEPKR; |
| 1387. | HKHLGVNEPKR; |
| 1388. | KRHLGVNEPKR; |
| 1389. | RRHLGVNEPKR; |
| 1390. | HRHLGVNEPKR; |
| 1391. | KHKLGVNEPKR; |
| 1392. | RKRLGVNEPKR; |
| 1393. | HHKLGVNEPKR; |
| 1394. | KKKLGVNEPKR; |
| 1395. | RKKLGVNEPKR; |
| 1396. | HKKLGVNEPKR; |
| 1397. | KRKLGVNEPKR; |
| 1398. | RRKLGVNEPKR; |
| 1399. | HRKLGVNEPKR; |
| 1400. | KHRLGVNEPKR; |
| 1401. | RHRLGVNEPKR; |
| 1402. | HHRLGVNEPKR; |
| 1403. | KKRLGVNEPKR; |
| 1404. | RKRLGVNEPKR; |
| 1405. | HKRLGVNEPKR; |
| 1406. | KRRLGVNEPKR; |
| 1407. | RRRLGVNEPKR; |
| 1408. | HRRLGVNEPKR; |
| 1409. | KHHIGVNEPKR; |
| 1410. | RHHIGVNEPKR; |
| 1411. | HHHIGVNEPKR; |
| 1412. | KKHIGVNEPKR; |
| 1413. | RKHIGVNEPKR; |
| 1414. | HKHIGVNEPKR; |

TABLE 7-continued

SEQ ID NO. shown to left of sequence(cont'd)

| | |
|---|---|
| 1415. | KRHIGVNEPKR; |
| 1416. | RRHIGVNEPKR; |
| 1417. | HRHIGVNEPKR; |
| 1418. | KHKIGVNEPKR; |
| 1419. | RHKIGVNEPKR; |
| 1420. | HHKIGVNEPKR; |
| 1421. | KKKIGVNEPKR; |
| 1422. | RKKIGVNEPKR; |
| 1423. | HKKIGVNEPKR; |
| 1424. | KRKIGVNEPKR; |
| 1425. | RRKIGVNEPKR; |
| 1426. | HRKIGVNEPKR; |
| 1427. | KHRIGVNEPKR; |
| 1428. | RHRIGVNEPKR; |
| 1429. | HHRIGVNEPKR; |
| 1430. | KKRIGVNEPKR; |
| 1431. | RKRIGVNEPKR; |
| 1432. | HKRIGVNEPKR; |
| 1433. | KRRIGVNEPKR; |
| 1434. | RRRIGVNEPKR; |
| 1435. | HRRVGVNEPKR; |
| 1436. | KHHVGVNEPKR; |
| 1437. | RHHVGVNEPKR; |
| 1438. | HHHVGVNEPKR; |
| 1439. | KKHVGVNEPKR; |
| 1440. | RKHVGVNEPKR; |
| 1441. | HKHVGVNEPKR; |
| 1442. | KRHVGVNEPKR; |
| 1443. | RRHVGVNEPKR; |
| 1444. | HRHVGVNEPKR; |
| 1445. | KHKVGVNEPKR; |
| 1446. | RHKVGVNEPKR; |
| 1447. | HHKVGVNEPKR; |
| 1448. | KKKVGVNEPKR; |
| 1449. | RKKVGVNEPKR; |
| 1450. | HKKVGVNEPKR; |
| 1451. | KRKVGVNEPKR; |
| 1452. | RRKVGVNEPKR; |
| 1453. | HRKVGVNEPKR; |

TABLE 7-continued

| SEQ ID NO. shown to left of sequence(cont'd) | |
|---|---|
| 1454. | KHRVGVNEPKR; |
| 1455. | RHRVGVNEPKR; |
| 1456. | HHRVGVNEPKR; |
| 1457. | KKRVGVNEPKR; |
| 1458. | RKRVGVNEPKR; |
| 1459. | HKRVGVNEPKR; |
| 1460. | KRRVGVNEPKR; |
| 1461. | RRRVGVNEPKR; |
| 1462. | HRRVGVNEPKR; |
| 1463. | KHHLGLENPKR; |
| 1464. | RHHLGLENPKR; |
| 1465. | HHHLGLENPKR; |
| 1466. | KKHLGLENPKR; |
| 1467. | RKHLGLENPKR; |
| 1468. | HKHLGLENPKR; |
| 1469. | KRHLGLENPKR; |
| 1470. | RRHLGLENPKR; |
| 1471. | HRHLGLENPKR; |
| 1472. | KHKLGLENPKR; |
| 1473. | RHKLGLENPKR; |
| 1474. | HHKLGLENPKR; |
| 1475. | KKKLGLENPKR; |
| 1476. | RKKLGLENPKR; |
| 1477. | HKKLGLENPKR; |
| 1478. | KRKLGLENPKR; |
| 1479. | RRKLGLENPKR; |
| 1480. | HRKLGLENPKR; |
| 1481. | KHRLGLENPKR; |
| 1482. | RHRLGLENPKR; |
| 1483. | HHRLGLENPKR; |
| 1484. | KKRLGLENPKR; |
| 1485. | RKRLGLENPKR; |
| 1486. | HKRLGLENPKR; |
| 1487. | KRRLGLENPKR; |
| 1488. | RRRLGLENPKR; |
| 1489. | HRRLGLENPKR; |
| 1490. | KHHIGLENPKR; |
| 1491. | RHHIGLENPKR; |
| 1492. | HHHIGLENPKR; |

TABLE 7-continued

| SEQ ID NO. shown to left of sequence(cont'd) | |
|---|---|
| 1493. | KKHIGLENPKR; |
| 1494. | RKHIGLENPKR; |
| 1495. | HKHIGLENPKR; |
| 1496. | KRHIGLENPKR; |
| 1497. | RRHVGLENPKR; |
| 1498. | HRHIGLENPKR; |
| 1499. | KHKIGLENPKR; |
| 1500. | RHKIGLENPKR; |
| 1501. | HHKIGLENPKR; |
| 1502. | KKKIGLENPKR; |
| 1503. | RKKIGLENPKR; |
| 1504. | HKKIGLENPKR; |
| 1505. | KRKVGLENPKR; |
| 1506. | RRKIGLENPKR; |
| 1507. | HRKIGLENPKR; |
| 1508. | KHRIGLENPKR; |
| 1509. | RHRIGLENPKR; |
| 1510. | HHRIGLENPKR; |
| 1511. | KKRIGLENPKR; |
| 1512. | RKRIGLENPKR; |
| 1513. | HKRIGLENPKR; |
| 1514. | KRRIGLENPKR; |
| 1515. | RRRIGLENPKR; |
| 1516. | HRRIGLENPKR; |
| 1517. | KHHVGLENPKR; |
| 1518. | RHHVGLENPKR; |
| 1519. | HHHVGLENPKR; |
| 1520. | KKHVGLENPKR; |
| 1521. | RKHVGLENPKR; |
| 1522. | HKHVGLENPKR; |
| 1523. | KRHVGLENPKR; |
| 1524. | RRHVGLENPKR; |
| 1525. | HRHVGLENPKR; |
| 1526. | KHKVGLENPKR; |
| 1527. | RHKVGLENPKR; |
| 1528. | HHKVGLENPKR; |
| 1529. | KKKVGLENPKR; |
| 1530. | RKKVGLENPKR; |
| 1531. | HKKVGLENPKR; |

TABLE 7-continued

SEQ ID NO. shown to left of sequence(cont'd)

| | |
|---|---|
| 1532. | KRKVGLENPKR; |
| 1533. | RRKVGLENPKR; |
| 1534. | HRKVGLENPKR; |
| 1535. | KHRVGLENPKR; |
| 1536. | RHRVGLENPKR; |
| 1537. | HHRVGLENPKR; |
| 1538. | KKRVGLENPKR; |
| 1539. | RKRVGLENPKR; |
| 1540. | HKRVGLENPKR; |
| 1541. | KRRVGLENPKR; |
| 1542. | RRRVGLENPKR; |
| 1543. | HRRVGLENPKR; |
| 1544. | KHHLGIENPKR; |
| 1545. | RHHLGIENPKR; |
| 1546. | HHHLGIENPKR; |
| 1547. | KKHLGIENPKR; |
| 1548. | RKHLGIENPKR; |
| 1549. | HKHLGIENPKR; |
| 1550. | KRHLGIENPKR; |
| 1551. | RRHLGIENPKR; |
| 1552. | HRHLGIENPKR; |
| 1553. | KHKLGIENPKR; |
| 1554. | RHKLGIENPKR; |
| 1555. | HHKLGIENPKR; |
| 1556. | KKKLGIENPKR; |
| 1557. | RKKLGIENPKR; |
| 1558. | HKKLGIENPKR; |
| 1559. | KRKLGIENPKR; |
| 1560. | RRKLGIENPKR; |
| 1561. | HRKLGIENPKR; |
| 1562. | KHRLGIENPKR; |
| 1563. | RHRLGIENPKR; |
| 1564. | HHRLGIENPKR; |
| 1565. | KKRLGIENPKR; |
| 1566. | RKRLGIENPKR; |
| 1567. | HKRLGIENPKR; |
| 1568. | KRRLGIENPKR; |
| 1569. | RRRLGIENPKR; |
| 1570. | HRRLGIENPKR; |

TABLE 7-continued

SEQ ID NO. shown to left of sequence(cont'd)

| | |
|---|---|
| 1571. | KHHIGIENPKR; |
| 1572. | RHHIGIENPKR; |
| 1573. | HHHIGIENPKR; |
| 1574. | KKHIGIENPKR; |
| 1575. | RKHIGIENPKR; |
| 1576. | HKHIGIENPKR; |
| 1577. | KRHIGIENPKR; |
| 1578. | RRHIGIENPKR; |
| 1579. | HRHIGIENPKR; |
| 1580. | KHKIGIENPKR; |
| 1581. | RHKIGIENPKR; |
| 1582. | HHKIGIENPKR; |
| 1583. | KKKIGIENPKR; |
| 1584. | RKKIGIENPKR; |
| 1585. | HKKIGIENPKR; |
| 1586. | KRKIGIENPKR; |
| 1587. | RRKIGIENPKR; |
| 1588. | HRKIGIENPKR; |
| 1589. | KHRIGIENPKR; |
| 1590. | RHRIGIENPKR; |
| 1591. | HHRIGIENPKR; |
| 1592. | KKRIGIENPKR; |
| 1593. | RKRIGIENPKR; |
| 1594. | HKRIGIENPKR; |
| 1595. | KRRIGIENPKR; |
| 1596. | RRRIGIENPKR; |
| 1597. | HRRIGIENPKR; |
| 1598. | KHHVGIENPKR; |
| 1599. | RHHVGIENPKR; |
| 1600. | HHHVGIENPKR; |
| 1601. | KKHVGIENPKR; |
| 1602. | RKHVGIENPKR; |
| 1603. | HKHVGIENPKR; |
| 1604. | KRHVGIENPKR; |
| 1605. | RRHVGIENPKR; |
| 1606. | HRHVGIENPKR; |
| 1607. | KHKVGIENPKR; |
| 1608. | RHKVGIENPKR; |
| 1609. | HHKVGIENPKR; |

TABLE 7-continued

SEQ ID NO. shown to left of sequence(cont'd)

| SEQ ID NO. | Sequence |
|---|---|
| 1610. | KKKVGIENPKR; |
| 1611. | RKKVGIENPKR; |
| 1612. | HKKVGIENPKR; |
| 1613. | KRKVGIENPKR; |
| 1614. | RRKVGIENPKR; |
| 1615. | HRKVGIENPKR; |
| 1616. | KHRVGIENPKR; |
| 1617. | RHRVGIENPKR; |
| 1618. | HHRVGIENPKR; |
| 1619. | KKRVGIENPKR; |
| 1620. | RKRVGIENPKR; |
| 1621. | HKRVGVENPKR; |
| 1622. | KRRVGIENPKR; |
| 1623. | RRRVGIENPKR; |
| 1624. | HRRVGIENPKR; |
| 1625. | KHHLGVENPKR; |
| 1626. | RHHLGVENPKR; |
| 1627. | HHHLGVENPKR; |
| 1628. | KKHLGVENPKR; |
| 1629. | RKHLGVENPKR; |
| 1630. | HKHLGVENPKR; |
| 1631. | KRHLGVENPKR; |
| 1632. | RRHLGVENPKR; |
| 1633. | HRHLGVENPKR; |
| 1634. | KHKLGVENPKR; |
| 1635. | RHKLGVENPKR; |
| 1636. | HHKLGVENPKR; |
| 1637. | KKKLGVENPKR; |
| 1638. | RKKLGVENPKR; |
| 1639. | HKKLGVENPKR; |
| 1640. | KRKLGVENPKR; |
| 1641. | RRKLGVENPKR; |
| 1642. | HRKLGVENPKR; |
| 1643. | KHRLGVENPKR; |
| 1644. | RHRLGVENPKR; |
| 1645. | HHRLGVENPKR; |
| 1646. | KKRLGVENPKR; |
| 1647. | RKRLGVENPKR; |
| 1648. | HKRLGVENPKR; |
| 1649. | KRRLGVENPKR; |
| 1650. | RRHLGVENPKR; |
| 1651. | HRRLGVENPKR; |
| 1652. | KHHIGVENPKR; |
| 1653. | RHHIGVEEPKR; |
| 1654. | HHHIGVENPKR; |
| 1655. | KKHIGVENPKR; |
| 1656. | RKHIGVENPKR; |
| 1657. | HKHIGVENPKR; |
| 1658. | KRHIGVENPKR; |
| 1659. | RRHVGVENPKR; |
| 1660. | HRHIGVENPKR; |
| 1661. | KHKIGVENPKR; |
| 1662. | RHKIGVENPKR; |
| 1663. | HHKIGVENPKR; |
| 1664. | KKKIGVENPKR; |
| 1665. | RKKIGVENPKR; |
| 1666. | HKKIGVENPKR; |
| 1667. | KRKIGVENPKR; |
| 1668. | RRKIGVENPKR; |
| 1669. | HRKIGVENPKR; |
| 1670. | KHRIGVENPKR; |
| 1671. | RHRIGVENPKR; |
| 1672. | HHRIGVENPKR; |
| 1673. | KKRIGVENPKR; |
| 1674. | RKRIGVENPKR; |
| 1675. | HKRIGVENPKR; |
| 1676. | KRRIGVENPKR; |
| 1677. | RRRIGVENPKR; |
| 1678. | HRRIGVENPKR; |
| 1679. | KHHVGVENPKR; |
| 1680. | RHHVGVENPKR; |
| 1681. | HHHVGVENPKR; |
| 1682. | KKHVGVENPKR; |
| 1683. | RKHVGVENPKR; |
| 1684. | HKHVGVENPKR; |
| 1685. | KRHVGVENPKR; |
| 1686. | RRHVGVENPKR; |
| 1687. | HRHVGVENPKR; |

TABLE 7-continued

| SEQ ID NO. shown to left of sequence(cont'd) | |
|---|---|
| 1688. | KHKVGVENPKR; |
| 1689. | RHKVGVENPKR; |
| 1690. | HHKVGVENPKR; |
| 1691. | KKKVGVENPKR; |
| 1692. | RKKVGVENPKR; |
| 1693. | HKKVGVENPKR; |
| 1694. | KRKVGVENPKR; |
| 1695. | RRKVGVEEPKR; |
| 1696. | HRKVGVENPKR; |
| 1697. | KHRVGVENPKR; |
| 1698. | RHRVGVENPKR; |
| 1699. | HHRVGVENPKR; |
| 1700. | KKRVGVENPKR; |
| 1701. | RKRVGVENPKR; |
| 1702. | HKRVGVENPKR; |
| 1703. | KRRVGVENPKR; |
| 1704. | RRRVGVENPKR; |
| 1705. | HRRVGVENPKR; |
| 1706. | KHHLGLNNPKR; |
| 1707. | RHHLGLNNPKR; |
| 1708. | HHHLGLNNPKR; |
| 1709. | KKHLGLNNPKR; |
| 1710. | RKHLGLNNPKR; |
| 1711. | HKHLGLNNPKR; |
| 1712. | KRHLGLNNPKR; |
| 1713. | RRHLGLNNPKR; |
| 1714. | HRHLGLNNPKR; |
| 1715. | KHKLGLNNPKR; |
| 1716. | RHKLGLNNPKR; |
| 1717. | HHKLGLNNPKR; |
| 1718. | KKKLGLNNPKR; |
| 1719. | RKKLGLNNPKR; |
| 1720. | HKKLGLNNPKR; |
| 1721. | KRKLGLNNPKR; |
| 1722. | RRKLGLNNPKR; |
| 1723. | HRKLGLNNPKR; |
| 1724. | KHRLGLNNPKR; |
| 1725. | RHRLGLNNPKR; |
| 1726. | HHRLGLNNPKR; |
| 1727. | KKRLGLNNPKR; |
| 1728. | RKRLGLNNPKR; |
| 1729. | HKRLGLNNPKR; |
| 1730. | KRRLGLNNPKR; |
| 1731. | RRRLGLNNPKR; |
| 1732. | HRRLGLNNPKR; |
| 1733. | KHHIGLNNPKR; |
| 1734. | RHHIGLNNPKR; |
| 1735. | HHHIGLNNPKR; |
| 1736. | KKHIGLNNPKR; |
| 1737. | RKHIGLNNPKR; |
| 1738. | HKHIGLNNPKR; |
| 1739. | KRHIGLNNPKR; |
| 1740. | RRHIGLNNPKR; |
| 1741. | HRHIGLNNPKR; |
| 1742. | KHKIGLNNPKR; |
| 1743. | RHKIGLNNPKR; |
| 1744. | HHKIGLNNPKR; |
| 1745. | KKKIGLNNPKR; |
| 1746. | RKKIGLNNPKR; |
| 1747. | HKKIGLNNPKR; |
| 1748. | KRKIGLNNPKR; |
| 1749. | RRKIGLNNPKR; |
| 1750. | HRKIGLNNPKR; |
| 1751. | KHRIGLNNPKR; |
| 1752. | RHRIGLNNPKR; |
| 1753. | HHRIGLNNPKR; |
| 1754. | KKRIGLNNPKR; |
| 1755. | RKRIGLNNPKR; |
| 1756. | HKRIGLNNPKR; |
| 1757. | KRRIGLNNPKR; |
| 1758. | RRRIGLNNPKR; |
| 1759. | HRRIGLNNPKR; |
| 1760. | KHHVGLNNPKR; |
| 1761. | RHHVGLNNPKR; |
| 1762. | HHHVGLNNPKR; |
| 1763. | KKHVGLNNPKR; |
| 1764. | RKHVGLNNPKR; |
| 1765. | HKHVGLNNPKR; |

TABLE 7-continued

SEQ ID NO. shown to left of sequence(cont'd)

| SEQ ID NO. | Sequence |
|---|---|
| 1766. | KRHVGLNNPKR; |
| 1767. | RRHVGLNNPKR; |
| 1768. | HRHVGLNNPKR; |
| 1769. | KHKVGLNNPKR; |
| 1770. | RHKVGLNNPKR; |
| 1771. | HHKVGLNNPKR; |
| 1772. | KKKVGLNNPKR; |
| 1773. | RKKVGLNNPKR; |
| 1774. | HKKVGLNNPKR; |
| 1775. | KRKVGLNNPKR; |
| 1776. | RRKVGLNNPKR; |
| 1777. | HRKVGLNNPKR; |
| 1778. | KHRVGLNNPKR; |
| 1779. | RHRVGLNNPKR; |
| 1780. | HHRVGLNNPKR; |
| 1781. | KKRVGLNNPKR; |
| 1782. | RKRVGLNNPKR; |
| 1783. | HKRVGLNNPKR; |
| 1784. | KRRVGLNNPKR; |
| 1785. | RRRVGLNNPKR; |
| 1786. | HRRVGLNNPKR; |
| 1787. | KHHLGINNPKR; |
| 1788. | RHHLGINNPKR; |
| 1789. | HHHLGINNPKR; |
| 1790. | KKHLGINNPKR; |
| 1791. | RKHLGINNPKR; |
| 1792. | HKHLGINNPKR; |
| 1793. | KRHLGINNPKR; |
| 1794. | RRHLGINNPKR; |
| 1795. | HRHLGINNPKR; |
| 1796. | KHKLGINNPKR; |
| 1797. | RHKLGINNPKR; |
| 1798. | HHKLGINNPKR; |
| 1799. | KKKLGINNPKR; |
| 1800. | RKKLGINNPKR; |
| 1801. | HKKLGINNPKR; |
| 1802. | KRKLGINNPKR; |
| 1803. | RRKLGINNPKR; |
| 1804. | HRKLGINNPKR; |
| 1805. | KHRLGINNPKR; |
| 1806. | RHRLGINNPKR; |
| 1807. | HHRLGINNPKR; |
| 1808. | KKRLGINNPKR; |
| 1809. | RKRLGINNPKR; |
| 1810. | HKRLGINNPKR; |
| 1811. | KRRLGINNPKR; |
| 1812. | RRRLGINNPKR; |
| 1813. | HRRLGINNPKR; |
| 1814. | KHHIGIENPKR; |
| 1815. | RHHIGINNPKR; |
| 1816. | HHHIGINNPKR; |
| 1817. | KKHIGINNPKR; |
| 1818. | RKHIGINNPKR; |
| 1819. | HKHIGINNPKR; |
| 1820. | KRHIGINNPKR; |
| 1821. | RRHIGINNPKR; |
| 1822. | HRHIGINNPKR; |
| 1823. | KHKIGINNPKR; |
| 1824. | RHKIGINNPKR; |
| 1825. | HHKIGINNPKR; |
| 1826. | KKKIGINNPKR; |
| 1827. | RKKIGINNPKR; |
| 1828. | HKKIGINNPKR; |
| 1829. | KRKIGINNPKR; |
| 1830. | RRKIGINNPKR; |
| 1831. | HRKIGINNPKR; |
| 1832. | KHRIGINNPKR; |
| 1833. | RHRIGINNPKR; |
| 1834. | HHRIGINNPKR; |
| 1835. | KKRIGINNPKR; |
| 1836. | RKRIGINNPKR; |
| 1837. | HKRIGINNPKR; |
| 1838. | KRRIGINNPKR; |
| 1839. | RRRIGINNPKR; |
| 1840. | HRRIGINNPKR; |
| 1841. | KHHVGINNPKR; |
| 1842. | RHHVGINNPKR; |
| 1843. | HHHVGINNPKR; |

TABLE 7-continued

SEQ ID NO. shown to left of sequence(cont'd)

| | |
|---|---|
| 1844. | KKHVGINNPKR; |
| 1845. | RKHVGINNPKR; |
| 1846. | HKHVGINNPKR; |
| 1847. | KRRVGINNPKR; |
| 1848. | RRHVGINNPKR; |
| 1849. | HRHVGINNPKR; |
| 1850. | KHKVGINNPKR; |
| 1851. | RHKVGINNPKR; |
| 1852. | HHKVGINNPKR; |
| 1853. | KKKVGINNPKR; |
| 1854. | RKKVGINNPKR; |
| 1855. | HKKVGINNPKR; |
| 1856. | KRKVGINNPKR; |
| 1857. | RRKVGINNPKR; |
| 1858. | HRKVGINNPKR; |
| 1859. | KHRVGINNPKR; |
| 1860. | RHRVGINNPKR; |
| 1861. | HHRVGINNPKR; |
| 1862. | KKRVGINNPKR; |
| 1863. | RKRVGINNPKR; |
| 1864. | HKRVGINNPKR; |
| 1865. | KRRVGINNPKR; |
| 1866. | RRRVGINNPKR; |
| 1867. | HRRVGINNPKR; |
| 1868. | KHHLGVNNPKR; |
| 1869. | RHHLGVNNPKR; |
| 1870. | HHHLGVNNPKR; |
| 1871. | KKHLGVNNPKR; |
| 1872. | RKHLGVNNPKR; |
| 1873. | HKHLGVNNPKR; |
| 1874. | KRHLGVNNPKR; |
| 1875. | RRHLGVNNPKR; |
| 1876. | HRHLGVNNPKR; |
| 1877. | KHKLGVNNPKR; |
| 1878. | RHKLGVNNPKR; |
| 1879. | HHKLGVNNPKR; |
| 1880. | KKKLGVNNPKR; |
| 1881. | RKKLGVNNPKR; |
| 1882. | HKKLGVNNPKR; |

TABLE 7-continued

SEQ ID NO. shown to left of sequence(cont'd)

| | |
|---|---|
| 1883. | KRKLGVNNPKR; |
| 1884. | RRKLGVNNPKR; |
| 1885. | HRKLGVNNPKR; |
| 1886. | KHRLGVNNPKR; |
| 1887. | RHRLGVNNPKR; |
| 1888. | HHRLGVNNPKR; |
| 1889. | KKRLGVNNPKR; |
| 1890. | RKRLGVNNPKR; |
| 1891. | HKRLGVNNPKR; |
| 1892. | KRRLGVNNPKR; |
| 1893. | RRRLGVNNPKR; |
| 1894. | HRRLGVNNPKR; |
| 1895. | KHHIGVNNPKR; |
| 1896. | RHHIGVNNPKR; |
| 1897. | HHHIGVNNPKR; |
| 1898. | KKHIGVNNPKR; |
| 1899. | RKHIGVNNPKR; |
| 1900. | HKHIGVNNPKR; |
| 1901. | KRHIGVNNPKR; |
| 1902. | RRHIGVNNPKR; |
| 1903. | HRHIGVNNPKR; |
| 1904. | KHKIGVNNPKR; |
| 1905. | RHKIGVNNPKR; |
| 1906. | HHKIGVNNPKR; |
| 1907. | KKKIGVNNPKR; |
| 1908. | RKKIGVNNPKR; |
| 1909. | HKKIGVNNPKR; |
| 1910. | KRKIGVNNPKR; |
| 1911. | RRKIGVNNPKR; |
| 1912. | HRKIGVNNPKR; |
| 1913. | KHRIGVNNPKR; |
| 1914. | RHRIGVNNPKR; |
| 1915. | HHRIGVNNPKR; |
| 1916. | KKRIGVNNPKR; |
| 1917. | RKRIGVNNPKR; |
| 1918. | HKRIGVNNPKR; |
| 1919. | KRRIGVNNPKR; |
| 1920. | RRRIGVNNPKR; |
| 1921. | HRRIGVNNPKR; |

TABLE 7-continued

SEQ ID NO. shown to left of sequence(cont'd)

| | |
|---|---|
| 1922. | KHHVGVNNPKR; |
| 1923. | RHHVGVNNPKR; |
| 1924. | HHHVGVNNPKR; |
| 1925. | KKHVGVNNPKR; |
| 1926. | RKHVGVNNPKR; |
| 1927. | HKHVGVNNPKR; |
| 1928. | KRHVGVNNPKR; |
| 1929. | RRHVGVNNPKR; |
| 1930. | HRHVGVNNPKR; |
| 1931. | KHKVGVNNPKR; |
| 1932. | RHKVGVNNPKR; |
| 1933. | HHKVGVNNPKR; |
| 1934. | KKKVGVNNPKR; |
| 1935. | RKKVGVNNPKR; |
| 1936. | HKKVGVNNPKR; |
| 1937. | KRKVGVNNPKR; |
| 1938. | RRKVGVNNPKR; |
| 1939. | HRKVGVNNPKR; |
| 1940. | KHRVGVNNPKR; |
| 1941. | RHRVGVNNPKR; |
| 1942. | HHRVGVNNPKR; |
| 1943. | KKRVGVNNPKR; |
| 1944. | RKRVGVNNPKR; |
| 1945. | HKRVGVNNPKR; |
| 1946. | KRRVGVNNPKR; |
| 1947. | RRRVGVNNPKR; |
| 1948. | HRRVGVNNPKR; |
| 1949. | KHHLGLEEPKH; |
| 1950. | RHHLGLEEPKH; |
| 1951. | HHHLGLEEPKH; |
| 1952. | KKHLGLEEPKH; |
| 1953. | RKHLGLEEPKH; |
| 1954. | HKHLGLEEPKH; |
| 1955. | KRHLGLEEPKH; |
| 1956. | RRHLGLEEPKH; |
| 1957. | HRHLGLEEPKH; |
| 1958. | KHKLGLEEPKH; |
| 1959. | RHKLGLEEPKH; |
| 1960. | HHKLGLEEPKH; |

TABLE 7-continued

SEQ ID NO. shown to left of sequence(cont'd)

| | |
|---|---|
| 1961. | KKRLGLEEPKH; |
| 1962. | RKKLGLEEPKH; |
| 1963. | HKKLGLEEPKH; |
| 1964. | KRKLGLEEPKH; |
| 1965. | RRKLGLEEPKH; |
| 1966. | HRKLGLEEPKH; |
| 1967. | KHRLGLEEPKH; |
| 1968. | RHRLGLEEPKH; |
| 1969. | HHRLGLEEPKH; |
| 1970. | KKRLGLEEPKH; |
| 1971. | RKRLGLEEPKH; |
| 1972. | HKRLGLEEPKH; |
| 1973. | KRRLGLEEPKH; |
| 1974. | RRRLGLEEPKH; |
| 1975. | HRRLGLEEPKH; |
| 1976. | KHHIGLEEPKH; |
| 1977. | RHHIGLEEPKH; |
| 1978. | HHHIGLEEPKH; |
| 1979. | KKHIGLEEPKH; |
| 1980. | RKHIGLEEPKH; |
| 1981. | HKHIGLEEPKH; |
| 1982. | KRHIGLEEPKH; |
| 1983. | RRHIGLEEPKH; |
| 1984. | HRHIGLEEPKH; |
| 1985. | KHKIGLEEPKH; |
| 1986. | RHKIGLEEPKH; |
| 1987. | HHKIGLEEPKH; |
| 1988. | KKKIGLEEPKH; |
| 1989. | RKKIGLEEPKH; |
| 1990. | HKKIGLEEPKH; |
| 1991. | KRKIGLEEPKH; |
| 1992. | RRKIGLEEPKH; |
| 1993. | HRKIGLEEPKH; |
| 1994. | KHRIGLEEPKH; |
| 1995. | RHRIGLEEPKH; |
| 1996. | HHRIGLEEPKH; |
| 1997. | KKRIGLEEPKH; |
| 1998. | RKRIGLEEPKH; |
| 1999. | HKRIGLEEPKH; |

TABLE 7-continued

SEQ ID NO. shown to left of sequence (cont'd)

| SEQ ID NO. | Sequence |
|---|---|
| 2000. | KRRIGLEEPKH; |
| 2001. | RRRIGLEEPKH; |
| 2002. | HRRIGLEEPKH; |
| 2003. | KHHVGLEEPKH; |
| 2004. | RHHVGLEEPKH; |
| 2005. | HHHVGLEEPKH; |
| 2006. | KKHVGLEEPKH; |
| 2007. | RKHVGLEEPKH; |
| 2008. | HKHVGLEEPKH; |
| 2009. | KRHVGLEEPKH; |
| 2010. | RRHVGLEEPKH; |
| 2011. | HRHVGLEEPKH; |
| 2012. | KHKVGLEEPKH; |
| 2013. | RHKVGLEEPKH; |
| 2014. | HHKVGLEEPKH; |
| 2015. | KKKVGLEEPKH; |
| 2016. | RKKVGLEEPKH; |
| 2017. | HKKVGLEEPKH; |
| 2018. | KRKVGLEEPKH; |
| 2019. | RRKVGLEEPKH; |
| 2020. | HRKVGLEEPKH; |
| 2021. | KHRVGLEEPKH; |
| 2022. | RHRVGLEEPKH; |
| 2023. | HHRVGLEEPKH; |
| 2024. | KKRVGLEEPKH; |
| 2025. | RKRVGLEEPKH; |
| 2026. | HKRVGLEEPKH; |
| 2027. | KRRVGLEEPKH; |
| 2028. | RRRVGLEEPKH; |
| 2029. | HRRVGLEEPKH; |
| 2030. | KHHLGIEEPKH; |
| 2031. | RHHLGIEEPKH; |
| 2032. | HHHLGIEEPKH; |
| 2033. | KKHLGIEEPKH; |
| 2034. | RKHLGIEEPKH; |
| 2035. | HKHLGIEEPKH; |
| 2036. | KRHLGIEEPKH; |
| 2037. | RRHLGIEEPKH; |
| 2038. | HRHLGIEEPKH; |
| 2039. | KHKLGIEEPKH; |
| 2040. | RHKLGIEEPKH; |
| 2041. | HHKLGIEEPKH; |
| 2042. | KKKLGIEEPKH; |
| 2043. | RKKLGIEEPKH; |
| 2044. | HKKLGIEEPKH; |
| 2045. | KRKLGIEEPKH; |
| 2046. | RRKLGIEEPKH; |
| 2047. | HRKLGIEEPKH; |
| 2048. | KHRLGIEEPKH; |
| 2049. | RHRLGIEEPKH; |
| 2050. | HHRLGIEEPKH; |
| 2051. | KKRLGIEEPKH; |
| 2052. | RKRLGIEEPKH; |
| 2053. | HKRLGIEEPKH; |
| 2054. | KRRLGIEEPKH; |
| 2055. | RRRLGIEEPKH; |
| 2056. | HRRLGIEEPKH; |
| 2057. | KHHIGIEEPKH; |
| 2058. | RHHIGIEEPKH; |
| 2059. | HHHIGIEEPKH; |
| 2060. | KKHIGIEEPKH; |
| 2061. | RKHIGIEEPKH; |
| 2062. | HKHIGIEEPKH; |
| 2063. | KRHIGIEEPKH; |
| 2064. | RRHIGIEEPKH; |
| 2065. | HRHIGIEEPKH; |
| 2066. | KHKIGIEEPKH; |
| 2067. | RHKIGIEEPKH; |
| 2068. | HHKIGIEEPKH; |
| 2069. | KKKIGIEEPKH; |
| 2070. | RKKIGIEEPKH; |
| 2071. | HKKIGIEEPKH; |
| 2072. | KRKIGIEEPKH; |
| 2073. | RRKIGIEEPKH; |
| 2074. | HRKIGIEEPKH; |
| 2075. | KHRIGIEEPKH; |
| 2076. | RHRIGIEEPKH; |
| 2077. | HHRIGIEEPKH; |

TABLE 7-continued

| SEQ ID NO. shown to left of sequence(cont'd) | |
|---|---|
| 2078. | KKRIGIEEPKH; |
| 2079. | RKRIGIEEPKH; |
| 2080. | HKRIGIEEPKH; |
| 2081. | KRRIGIEEPKH; |
| 2082. | RRRIGIEEPKH; |
| 2083. | HRRIGIEEPKH; |
| 2084. | KHHVGIEEPKH; |
| 2085. | RHHVGIEEPKH; |
| 2086. | HHHVGIEEPKH; |
| 2087. | KKHVGIEEPKH; |
| 2088. | RKHVGIEEPKH; |
| 2089. | HKHVGIEEPKH; |
| 2090. | KRHVGIEEPKH; |
| 2091. | RRHVGIEEPKH; |
| 2092. | HRHVGIEEPKH; |
| 2093. | KHKVGIEEPKH; |
| 2094. | RHKVGIEEPKH; |
| 2095. | HHKVGIEEPKH; |
| 2096. | KKKVGIEEPKH; |
| 2097. | RKKVGIEEPKH; |
| 2098. | HKKVGIEEPKH; |
| 2099. | KRKVGIEEPKH; |
| 2100. | RRKVGIEEPKH; |
| 2101. | HRKVGIEEPKH; |
| 2102. | KHRVGIEEPKH; |
| 2103. | RHRVGIEEPKH; |
| 2104. | HHRVGIEEPKH; |
| 2105. | KKRVGIEEPKH; |
| 2106. | RKRVGIEEPKH; |
| 2107. | HKRVGIEEPKH; |
| 2108. | KRRVGIEEPKH; |
| 2109. | RRRVGIEEPKH; |
| 2110. | HRRVGIEEPKH; |
| 2111. | KHHLGVEEPKH; |
| 2112. | RHHLGVEEPKH; |
| 2113. | HHHLGVEEPKH; |
| 2114. | KKHLGVEEPKH; |
| 2115. | RKHLGVEEPKH; |
| 2116. | HKHLGVEEPKH; |
| 2117. | KRHLGVEEPKH; |
| 2118. | RRHLGVEEPKH; |
| 2119. | HRHLGVEEPKH; |
| 2120. | KHKLGVEEPKH; |
| 2121. | RHKLGVEEPKH; |
| 2122. | HHKLGVEEPKH; |
| 2123. | KKKLGVEEPKH; |
| 2124. | RKKLGVEEPKH; |
| 2125. | HKKLGVEEPKH; |
| 2126. | KRKLGVEEPKH; |
| 2127. | RRKLGVEEPKH; |
| 2128. | HRKLGVEEPKH; |
| 2129. | KHRLGVEEPKH; |
| 2130. | RHRLGVEEPKH; |
| 2131. | HHRLGVEEPKH; |
| 2132. | KKRLGVEEPKH; |
| 2133. | RKRLGVEEPKH; |
| 2134. | HKRLGVEEPKH; |
| 2135. | KRRLGVEEPKH; |
| 2136. | RRRLGVEEPKH; |
| 2137. | HRRLGVEEPKH; |
| 2138. | KHHIGVEEPKH; |
| 2139. | RHHIGVEEPKH; |
| 2140. | HHHIGVEEPKH; |
| 2141. | KKHIGVEEPKH; |
| 2142. | RKHIGVEEPKH; |
| 2143. | HKHIGVEEPKH; |
| 2144. | KRHIGVEEPKH; |
| 2145. | RRHIGVEEPKH; |
| 2146. | HRHIGVEEPKH; |
| 2147. | KHKIGVEEPKH; |
| 2148. | RHKIGVEEPKH; |
| 2149. | HHKIGVEEPKH; |
| 2150. | KKKIGVEEPKH; |
| 2151. | RKKIGVEEPKH; |
| 2152. | HKKIGVEEPKH; |
| 2153. | KRKIGVEEPKH; |
| 2154. | RRKIGVEEPKH; |
| 2155. | HRKIGVEEPKH; |

TABLE 7-continued

SEQ ID NO. shown to left of sequence(cont'd)

| SEQ ID NO. | Sequence |
|---|---|
| 2156. | KHRIGVEEPKH; |
| 2157. | RHRIGVEEPKH; |
| 2158. | HHRIGVEEPKH; |
| 2159. | KKRIGVEEPKH; |
| 2160. | RKRIGVEEPKH; |
| 2161. | HKRIGVEEPKH; |
| 2162. | KRRIGVEEPKH; |
| 2163. | RRRIGVEEPKH; |
| 2164. | HRRIGVEEPKH; |
| 2165. | KHHVGVEEPKH; |
| 2166. | RHHVGVEEPKH; |
| 2167. | HHHVGVEEPKH; |
| 2168. | KKHVGVEEPKH; |
| 2169. | RKHVGVEEPKH; |
| 2170. | HKHVGVEEPKH; |
| 2171. | KRHVGVEEPKH; |
| 2172. | RRHVGVEEPKH; |
| 2173. | HRHVGVEEPKH; |
| 2174. | KHKVGVEEPKH; |
| 2175. | RHKVGVEEPKH; |
| 2176. | HHKVGVEEPKH; |
| 2177. | KKKVGVEEPKH; |
| 2178. | RKKVGVEEPKH; |
| 2179. | HKKVGVEEPKH; |
| 2180. | KRKVGVEEPKH; |
| 2181. | RRKVGVEEPKH; |
| 2182. | HRKVGVEEPKH; |
| 2183. | KHRVGVEEPKH; |
| 2184. | RHRVGVEEPKH; |
| 2185. | HHRVGVEEPKH; |
| 2186. | KKRVGVEEPKH; |
| 2187. | RKRVGVEEPKH; |
| 2188. | HKRVGVEEPKH; |
| 2189. | KRRVGVEEPKH; |
| 2190. | RRRVGVEEPKH; |
| 2191. | HRRVGVEEPKH; |
| 2192. | KHHLGLNEPKH; |
| 2193. | RHHLGLNEPKH; |
| 2194. | HHHLGLNEPKH; |
| 2195. | KKHLGLNEPKH; |
| 2196. | RKHLGLNEPKH; |
| 2197. | HKHLGLNEPKH; |
| 2198. | KRHLGLNEPKH; |
| 2199. | RRHLGLNEPKH; |
| 2200. | HRHLGLNEPKH; |
| 2201. | KHKLGLNEPKH; |
| 2202. | RHKLGLNEPKH; |
| 2203. | HHKLGLNEPKH; |
| 2204. | KKKLGLNEPKH; |
| 2205. | RKKLGLNEPKH; |
| 2206. | HKKLGLNEPKH; |
| 2207. | KRKLGLNEPKH; |
| 2208. | RRKLGLNEPKH; |
| 2209. | HRKLGLNEPKH; |
| 2210. | KHRLGLNEPKH; |
| 2211. | RHRLGLNEPKH; |
| 2212. | HHRLGLNEPKH; |
| 2213. | KKRLGLNEPKH; |
| 2214. | RKRLGLNEPKH; |
| 2215. | HKRLGLNEPKH; |
| 2216. | KRRLGLNEPKH; |
| 2217. | RRRLGLNEPKH; |
| 2218. | HRRLGLNEPKH; |
| 2219. | KHHIGLNPKH; |
| 2220. | RHHIGLNPKH; |
| 2221. | HHHIGLNPKH; |
| 2222. | KKHIGLNEPKH; |
| 2223. | RKHIGLNEPKH; |
| 2224. | HKHIGLNEPKH; |
| 2225. | KRHIGLNEPKH; |
| 2226. | RRHIGLNEPKH; |
| 2227. | HRHIGLNEPKH; |
| 2228. | KHKIGLNEPKH; |
| 2229. | RHKIGLNEPKH; |
| 2230. | HHKIGLNEPKH; |
| 2231. | KKKIGLNEPKH; |
| 2232. | RKKIGLNEPKH; |
| 2233. | HKKIGLNEPKH; |

TABLE 7-continued

SEQ ID NO. shown to left of sequence(cont'd)

| | |
|---|---|
| 2234. | KRKLGLNEPKH; |
| 2235. | RRKIGLNEPKH; |
| 2236. | HRKIGLNEPKH; |
| 2237. | KHRIGLNEPKH; |
| 2238. | RHRIGLNEPKH; |
| 2239. | HHRIGLNEPKH; |
| 2240. | KKRIGLNEPKH; |
| 2241. | RKRIGLNEPKH; |
| 2242. | HKRIGLNEPKH; |
| 2243. | KRRIGLNEPKH; |
| 2244. | RRRIGLNEPKH; |
| 2245. | HRRIGLNEPKH; |
| 2246. | KHHVGLNEPKH; |
| 2247. | RHHVGLNEPKH; |
| 2248. | HHHVGLNEPKH; |
| 2249. | KKHVGLNEPKH; |
| 2250. | RKHVGLNEPKH; |
| 2251. | HKHVGLNEPKH; |
| 2252. | KRHVGLNEPKH; |
| 2253. | RRHVGLNEPKH; |
| 2254. | HRHVGLNEPKH; |
| 2255. | KHKVGLNEPKH; |
| 2256. | RHKVGLNEPKH; |
| 2257. | HHKVGLNEPKH; |
| 2258. | KKKVGLNEPKH; |
| 2259. | RKKVGLNEPKH; |
| 2260. | HKKVGLNEPKH; |
| 2261. | KRKVGLNEPKH; |
| 2262. | RRKVGLNEPKH; |
| 2263. | HRKVGLNEPKH; |
| 2264. | KHRVGLNEPKH; |
| 2265. | RHRVGLNEPKH; |
| 2266. | HHRVGLNEPKH; |
| 2267. | KKRVGLNEPKH; |
| 2268. | RKRVGLNEPKH; |
| 2269. | HKRVGLNEPKH; |
| 2270. | KRRVGLNEPKH; |
| 2271. | RRRVGLNEPKH; |
| 2272. | HRRVGLNEPKH; |
| 2273. | KHHLGINEPKH; |
| 2274. | RHHLGINEPKH; |
| 2275. | HHHLGINEPKH; |
| 2276. | KKHLGINEPKH; |
| 2277. | RKHLGINEPKH; |
| 2278. | HKHLGINEPKH; |
| 2279. | KRHLGINEPKH; |
| 2280. | RRHLGINEPKH; |
| 2281. | HRHLGINEPKH; |
| 2282. | KHKLGINEPKH; |
| 2283. | RHKLGINEPKH; |
| 2284. | HHKLGINEPKH; |
| 2285. | KKKLGINEPKH; |
| 2286. | RKKLGINEPKH; |
| 2287. | HKKLGINEPKH; |
| 2288. | KRKLGINEPKH; |
| 2289. | RRKLGINEPKH; |
| 2290. | HRKLGINEPKH; |
| 2291. | KHRLGINEPKH; |
| 2292. | RHRLGINEPKH; |
| 2293. | HHRLGINEPKH; |
| 2294. | KKRLGINEPKH; |
| 2295. | RKRLGINEPKH; |
| 2296. | HKRLGINEPKH; |
| 2297. | KRRLGINEPKH; |
| 2298. | RRRLGINEPKH; |
| 2299. | HRRLGINEPKH; |
| 2300. | KHHIGINEPKH; |
| 2301. | RHHIGINEPKH; |
| 2302. | HHHIGINEPKH; |
| 2303. | KKHIGINEPKH; |
| 2304. | RKHIGINEPKH; |
| 2305. | HKHIGINEPKH; |
| 2306. | KRHIGINEPKH; |
| 2307. | RRHIGINEPKH; |
| 2308. | HRHIGINEPKH; |
| 2309. | KHKIGINEPKH; |
| 2310. | RHKIGINEPKH; |
| 2311. | HHKIGINEPKH; |

TABLE 7-continued

SEQ ID NO. shown to left of sequence(cont'd)

| SEQ ID NO. | Sequence |
|---|---|
| 2312. | KKKIGINEPKH; |
| 2313. | RKKIGINEPKH; |
| 2314. | HKKIGINEPKH; |
| 2315. | KRKIGINEPKH; |
| 2316. | RRKIGINEPKH; |
| 2317. | HRKIGINEPKH; |
| 2318. | KHRIGINEPKH; |
| 2319. | RHRIGINEPKH; |
| 2320. | HHRIGINEPKH; |
| 2321. | KKRIGINEPKH; |
| 2322. | RKRIGINEPKH; |
| 2323. | HKRIGINEPKH; |
| 2324. | KRRIGINEPKH; |
| 2325. | RRRIGINEPKH; |
| 2326. | HRRIGINEPKH; |
| 2327. | KHHVGINEPKH; |
| 2328. | RHHVGINEPKH; |
| 2329. | HHHVGINEPKH; |
| 2330. | KKHVGINEPKH; |
| 2331. | RKHVGINEPKH; |
| 2332. | HKHVGINEPKH; |
| 2333. | KRHVGINEPKH; |
| 2334. | RRHVGINEPKH; |
| 2335. | HRHVGINEPKH; |
| 2336. | KHKVGINEPKH; |
| 2337. | RHKVGINEPKH; |
| 2338. | HHKVGINEPKH; |
| 2339. | KKKVGINEPKH; |
| 2340. | RKKVGINEPKH; |
| 2341. | HKKVGINEPKH; |
| 2342. | KRKVGINEPKH; |
| 2343. | RRKVGINEPKH; |
| 2344. | HRKVGINEPKH; |
| 2345. | KHRVGINEPKH; |
| 2346. | RHRVGINEPKH; |
| 2347. | HHRVGINEPKH; |
| 2348. | KKRVGINEPKH; |
| 2349. | RKRVGINEPKH; |
| 2350. | HKRVGINEPKH; |
| 2351. | KRRVGINEPKH; |
| 2352. | RRRVGINEPKH; |
| 2353. | HRRVGINEPKH; |
| 2354. | KHHLGVNEPKH; |
| 2355. | RHHLGVNEPKH; |
| 2356. | HHHLGVNEPKH; |
| 2357. | KKHLGVNEPKH; |
| 2358. | RKHLGVNEPKH; |
| 2359. | HKHLGVNEPKH; |
| 2360. | KRHLGVNEPKH; |
| 2361. | RRHLGVNEPKH; |
| 2362. | HRHLGVNEPKH; |
| 2363. | KHKLGVNEPKH; |
| 2364. | RHKLGVNEPKH; |
| 2365. | HHKLGVNEPKH; |
| 2366. | KKKLGVNEPKH; |
| 2367. | RKKLGVNEPKH; |
| 2368. | HKKLGVNEPKH; |
| 2369. | KRKLGVNEPKH; |
| 2370. | RRKLGVNEPKH; |
| 2371. | HRKLGVNEPKH; |
| 2372. | KHRLGVNEPKH; |
| 2373. | RHRLGVNEPKH; |
| 2374. | HHRLGVNEPKH; |
| 2375. | KKRLGVNEPKH; |
| 2376. | RKRLGVNEPKH; |
| 2377. | HKRLGVNEPKH; |
| 2378. | KRRLGVNEPKH; |
| 2379. | RRRLGVNEPKH; |
| 2380. | HRRLGVNEPKH; |
| 2381. | KHHIGVNEPKH; |
| 2382. | RHHIGVNEPKH; |
| 2383. | HHHIGVNEPKH; |
| 2384. | KKHIGVNEPKH; |
| 2385. | RKHIGVNEPKH; |
| 2386. | HKHIGVNEPKH; |
| 2387. | KRHIGVNEPKH; |
| 2388. | RRHIGVNEPKH; |
| 2389. | HRHIGVNEPKH; |

TABLE 7-continued

SEQ ID NO. shown to left of sequence(cont'd)

| SEQ ID NO. | Sequence |
|---|---|
| 2390. | KHKIGVNEPKH; |
| 2391. | RHKIGVNEPKH; |
| 2392. | HHKIGVNEPKH; |
| 2393. | KKKIGVNEPKH; |
| 2394. | RKKIGVNEPKH; |
| 2395. | HKKIGVNEPKH; |
| 2396. | KRKIGVNEPKH; |
| 2397. | RRKIGVNEPKH; |
| 2398. | HRKIGVNEPKH; |
| 2399. | KHRIGVNEPKH; |
| 2400. | RHRIGVNEPKH; |
| 2401. | HHRIGVNEPKH; |
| 2402. | KKRIGVNEPKH; |
| 2403. | RKRIGVNEPKH; |
| 2404. | HKRIGVNEPKH; |
| 2405. | KRRIGVNEPKH; |
| 2406. | RRRIGVNEPKH; |
| 2407. | HRRIGVNEPKH; |
| 2408. | KHHVGVNEPKH; |
| 2409. | RHHVGVNEPKH; |
| 2410. | HHHVGVNEPKH; |
| 2411. | KKHVGVNEPKH; |
| 2412. | RKHVGVNEPKH; |
| 2413. | HKHVGVNEPKH; |
| 2414. | KRHVGVNEPKH; |
| 2415. | RRHVGVNEPKH; |
| 2416. | HRHVGVNEPKH; |
| 2417. | KHKVGVNEPKH; |
| 2418. | RHKVGVNEPKH; |
| 2419. | HHKVGVNEPKH; |
| 2420. | KKKVGVNEPKH; |
| 2421. | RKKVGVNEPKH; |
| 2422. | HKKVGVNEPKH; |
| 2423. | KRKVGVNEPKH; |
| 2424. | RRKVGVNEPKH; |
| 2425. | HRKVGVNEPKH; |
| 2426. | KHRVGVNEPKH; |
| 2427. | RHRVGVNEPKH; |
| 2428. | HHRVGVNEPKH; |
| 2429. | KKRVGVNEPKH; |
| 2430. | RKRVGVNEPKH; |
| 2431. | HKRVGVNEPKH; |
| 2432. | KRRVGVNEPKH; |
| 2433. | RRRVGVNEPKH; |
| 2434. | HRRVGVNEPKH; |
| 2435. | KHHLGLENPKH; |
| 2436. | RHHLGLENPKH; |
| 2437. | HHHLGLENPKH; |
| 2438. | KKHLGLENPKH; |
| 2439. | RKHLGLENPKH; |
| 2440. | HKHLGLENPKH; |
| 2441. | KRHLGLENPKH; |
| 2442. | RRHLGLENPKH; |
| 2443. | HRHLGLENPKH; |
| 2444. | KHKLGLENPKH; |
| 2445. | RHKLGLENPKH; |
| 2446. | HHKLGLENPKH; |
| 2447. | KKKLGLENPKH; |
| 2448. | RKKLGLENPKH; |
| 2449. | HKKLGLENPKH; |
| 2450. | KRKLGLENPKH; |
| 2451. | RRKLGLENPKH; |
| 2452. | HRKLGLENPKH; |
| 2453. | KHRLGLENPKH; |
| 2454. | RHRLGLENPKH; |
| 2455. | HHRLGLENPKH; |
| 2456. | KKRLGLENPKH; |
| 2457. | RKRLGLENPKH; |
| 2458. | HKRLGLENPKH; |
| 2459. | KRRLGLENPKH; |
| 2460. | RRRLGLENPKH; |
| 2461. | HRRLGLENPKH; |
| 2462. | KHHIGLENPKH; |
| 2463. | RHHIGLENPKH; |
| 2464. | HHHIGLENPKH; |
| 2465. | KKHIGLENPKH; |
| 2466. | RKHIGLENPKH; |
| 2467. | HKHIGLENPKH; |

TABLE 7-continued

SEQ ID NO. shown to left of sequence(cont'd)

| | |
|---|---|
| 2468. | KRHIGLENPKH; |
| 2469. | RRHIGLENPKH; |
| 2470. | HRHIGLENPKH; |
| 2471. | KHKIGLENPKH; |
| 2472. | RHKIGLENPKH; |
| 2473. | HHKIGLENPKH; |
| 2474. | KKKIGLENPKH; |
| 2475. | RKKIGLENPKH; |
| 2476. | HKKIGLENPKH; |
| 2477. | KRKIGLENPKH; |
| 2478. | RRKIGLENPKH; |
| 2479. | HRKIGLENPKH; |
| 2480. | KHRIGLENPKH; |
| 2481. | RHRIGLENPKH; |
| 2482. | HHRIGLENPKH; |
| 2483. | KKRIGLENPKH; |
| 2484. | RKRIGLENPKH; |
| 2485. | HKRIGLENPKH; |
| 2486. | KRRIGLENPKH; |
| 2487. | RRRIGLENPKH; |
| 2488. | HRRIGLENPKH; |
| 2489. | KHHVGLENPKH; |
| 2490. | RHHVGLENPKH; |
| 2491. | HHHVGLENPKH; |
| 2492. | KKHVGLENPKH; |
| 2493. | RKHVGLENPKH; |
| 2494. | HKHVGLENPKH; |
| 2495. | KRHVGLENPKH; |
| 2496. | RRHVGLENPKH; |
| 2497. | HRHVGLENPKH; |
| 2498. | KHKVGLENPKH; |
| 2499. | RHKVGLENPKH; |
| 2500. | HHKVGLENPKH; |
| 2501. | KKKVGLENPKH; |
| 2502. | RKKVGLENPKH; |
| 2503. | HKKVGLENPKH; |
| 2504. | KRKVGLENPKH; |
| 2505. | RRKVGLENPKH; |
| 2506. | HRKVGLENPKH; |

TABLE 7-continued

SEQ ID NO. shown to left of sequence(cont'd)

| | |
|---|---|
| 2507. | KHRVGLENPKH; |
| 2508. | RHRVGLENPKH; |
| 2509. | HHRVGLENPKH; |
| 2510. | KKRVGLENPKH; |
| 2511. | RKRVGLENPKH; |
| 2512. | HKRVGLENPKH; |
| 2513. | KRRVGLENPKH; |
| 2514. | RRRVGLENPKH; |
| 2515. | HRRVGLENPKH; |
| 2516. | KHHLGIENPKH; |
| 2517. | RHHLGIENPKH; |
| 2518. | HHHLGIENPKH; |
| 2519. | KKHLGIENPKH; |
| 2520. | RKHLGIENPKH; |
| 2521. | HKHLGIENPKH; |
| 2522. | KRHLGIENPKH; |
| 2523. | RRHLGIENPKH; |
| 2524. | HRHLGIENPKH; |
| 2525. | KHKLGIENPKH; |
| 2526. | RHKLGIENPKH; |
| 2527. | HHKLGIENPKH; |
| 2528. | KKKLGIENPKH; |
| 2529. | RKKLGIENPKH; |
| 2530. | HKKLGIENPKH; |
| 2531. | KRKLGIENPKH; |
| 2532. | RRKLGIENPKH; |
| 2533. | HRKLGIENPKH; |
| 2534. | KHRLGIENPKH; |
| 2535. | RHRLGIENPKH; |
| 2536. | HHRLGIENPKH; |
| 2537. | KKRLGIENPKH; |
| 2538. | RKRLGIENPKH; |
| 2539. | HKRLGIENPKH; |
| 2540. | KRRLGIENPKH; |
| 2541. | RRRLGIENPKH; |
| 2542. | HRRLGIENPKH; |
| 2543. | KHHIGIENPKH; |
| 2544. | RHHIGIENPKH; |
| 2545. | HHHIGIENPKH; |

TABLE 7-continued

SEQ ID NO. shown to left of sequence(cont'd)

| SEQ ID NO. | Sequence |
|---|---|
| 2546. | KKHIGIENPKH; |
| 2547. | RKHIGIENPKH; |
| 2548. | HKHIGIENPKH; |
| 2549. | KRHIGIENPKH; |
| 2550. | RRHIGIENPKH; |
| 2551. | HRHIGIENPKH; |
| 2552. | KHHIGIENPKH; |
| 2553. | RHKIGIENPKH; |
| 2554. | HHKIGIENPKH; |
| 2555. | KKKIGIENPKH; |
| 2556. | RKKIGIENPKH; |
| 2557. | HKKIGIENPKH; |
| 2558. | KRKIGIENPKH; |
| 2559. | RRKIGIENPKH; |
| 2560. | HRKIGIENPKH; |
| 2561. | KHRIGIENPKH; |
| 2562. | RHRIGIENPKH; |
| 2563. | HHRIGIENPKH; |
| 2564. | KKRIGIENPKH; |
| 2565. | RKRIGIENPKH; |
| 2566. | HKRIGIENPKH; |
| 2567. | KRRIGIENPKH; |
| 2568. | RRRIGIENPKH; |
| 2569. | HRRIGIENPKH; |
| 2570. | KHHVGIENPKH; |
| 2571. | RHHVGIENPKH; |
| 2572. | HHHVGIENPKH; |
| 2571. | KKHVGIENPKH; |
| 2574. | RKHVGIENPKH; |
| 2575. | HKHVGIENPKH; |
| 2576. | KRHVGIENPKH; |
| 2577. | RRHVGIENPKH; |
| 2578. | HRHVGIENPKH; |
| 2579. | KHKVGIENPKH; |
| 2580. | RHKVGIENPKH; |
| 2581. | HHKVGIENPKH; |
| 2582. | KKKVGIENPKH; |
| 2583. | RKKVGIENPKH; |
| 2584. | HKKVGIENPKH; |
| 2585. | KRKVGIENPKH; |
| 2586. | RRKVGIENPKH; |
| 2587. | HRKVGIENPKH; |
| 2588. | KHRVGIENPKH; |
| 2589. | RHRVGIENPKH; |
| 2590. | HHRVGIENPKH; |
| 2591. | KKRVGIENPKH; |
| 2592. | RKRVGIENPKH; |
| 2593. | HKRVGIENPKH; |
| 2594. | KRRVGIENPKH; |
| 2595. | RRRVGIENPKH; |
| 2596. | HRRVGIENPKH; |
| 2597. | KHHLGVENPKH; |
| 2598. | RHHLGVENPKH; |
| 2599. | HHHLGVENPKH; |
| 2600. | KKHLGVENPKH; |
| 2601. | RKHLGVENPKH; |
| 2602. | HKHLGVENPKH; |
| 2603. | KRHLGVENPKH; |
| 2604. | RRHLGVENPKH; |
| 2605. | HRHLGVENPKH; |
| 2606. | KHKLGVENPKH; |
| 2607. | RHKLGVENPKH; |
| 2608. | HHKLGVENPKH; |
| 2609. | KKKLGVENPKH; |
| 2610. | RKKLGVENPKH; |
| 2611. | HKKLGVENPKH; |
| 2612. | KRKLGVENPKH; |
| 2613. | RRKLGVENPKH; |
| 2614. | HRKLGVENPKH; |
| 2615. | KHRLGVENPKH; |
| 2616. | RHRLGVENPKH; |
| 2617. | HHRLGVENPKH; |
| 2618. | KKRLGVENPKH; |
| 2619. | RKRLGVENPKH; |
| 2620. | HKRLGVENPKH; |
| 2621. | KRRLGVENPKH; |
| 2622. | RRRLGVENPKH; |
| 2623. | HRRLGVENPKH; |

TABLE 7-continued

SEQ ID NO. shown to left of sequence(cont'd)

| | |
|---|---|
| 2624. | KHHIGVENPKH; |
| 2625. | RHHIGVEEPKH; |
| 2626. | HHHIGVENPKH; |
| 2627. | KKHIGVENPKH; |
| 2628. | RKHIGVENPKH; |
| 2629. | HKHIGVENPKH; |
| 2630. | KRHIGVENPKH; |
| 2631. | RRHIGVENPKH; |
| 2632. | HRHIGVENPKH; |
| 2633. | KHKIGVENPKH; |
| 2634. | RHKIGVENPKH; |
| 2635. | HHKIGVENPKH; |
| 2636. | KKKIGVENPKH; |
| 2637. | RKKIGVENPKH; |
| 2638. | HKKIGVENPKH; |
| 2639. | KRKIGVENPKH; |
| 2640. | RRKIGVENPKH; |
| 2641. | HRKIGVENPKH; |
| 2642. | KHRIGVENPKH; |
| 2643. | RHRIGVENPKH; |
| 2644. | HHRIGVENPKH; |
| 2645. | KKRIGVENPKH; |
| 2646. | RKRIGVENPKH; |
| 2647. | HKRIGVENPKH; |
| 2648. | KRRIGVENPKH; |
| 2649. | RRRIGVENPKH; |
| 2650. | HRRIGVENPKH; |
| 2651. | KHHVGVENPKH; |
| 2652. | RHHVGVENPKH; |
| 2653. | HHHVGVENPKH; |
| 2654. | KKHVGVENPKH; |
| 2655. | RKHVGVENPKH; |
| 2656. | HKHVGVENPKH; |
| 2657. | KRHVGVENPKH; |
| 2658. | RRHVGVENPKH; |
| 2659. | HRHVGVENPKH; |
| 2660. | KHKVGVENPKH; |
| 2661. | RHKVGVENPKH; |
| 2662. | HHKVGVENPKH; |

TABLE 7-continued

SEQ ID NO. shown to left of sequence(cont'd)

| | |
|---|---|
| 2663. | KKKVGVENPKH; |
| 2664. | RKKVGVENPKH; |
| 2665. | HKKVGVENPKH; |
| 2666. | KRKVGVENPKH; |
| 2667. | RRKVGVEEPKH; |
| 2668. | HRKVGVENPKH; |
| 2669. | KHRVGVENPKH; |
| 2670. | RHRVGVENPKH; |
| 2671. | HHRVGVENPKH; |
| 2672. | KKRVGVENPKH; |
| 2673. | RKRVGVENPKH; |
| 2674. | HKRVGVENPKH; |
| 2675. | KRRVGVENPKH; |
| 2676. | RRRVGVENPKH; |
| 2677. | HRRVGVENPKH; |
| 2678. | KHHLGLNNPKH; |
| 2679. | RHHLGLNNPKH; |
| 2680. | HHHLGLNNPKH; |
| 2681. | KKHLGLNNPKH; |
| 2682. | RKHLGLNNPKH; |
| 2683. | HKHLGLNNPKH; |
| 2684. | KRHLGLNNPKH; |
| 2685. | RRHLGLNNPKH; |
| 2686. | HRHLGLNNPKH; |
| 2687. | KHKLGLNNPKH; |
| 2688. | RHKLGLNNPKH; |
| 2689. | HHKLGLNNPKH; |
| 2690. | KKKLGLNNPKH; |
| 2691. | RKKLGLNNPKH; |
| 2692. | HKKLGLNNPKH; |
| 2693. | KRKLGLNNPKH; |
| 2694. | RRKLGLNNPKH; |
| 2695. | HRKLGLNNPKH; |
| 2696. | KHRLGLNNPKH; |
| 2697. | RHRLGLNNPKH; |
| 2698. | HHRLGLNNPKH; |
| 2699. | KKRLGLNNPKH; |
| 2700. | RKRLGLNNPKH; |
| 2701. | HKRLGLNNPKH; |

TABLE 7-continued

SEQ ID NO. shown to left of sequence(cont'd)

| SEQ ID NO. | Sequence |
|---|---|
| 2702. | KRRLGLNNPKH; |
| 2703. | RRRLGLNNPKH; |
| 2704. | HRRLGLNNPKH; |
| 2705. | KHHIGLNNPKH; |
| 2706. | RHHIGLNNPKH; |
| 2707. | HHHIGLNNPKH; |
| 2708. | KKHIGLNNPKH; |
| 2709. | RKHIGLNNPKH; |
| 2710. | HKHIGLNNPKH; |
| 2711. | KRHIGLNNPKH; |
| 2712. | RRHIGLNNPKH; |
| 2713. | HRHIGLNNPKH; |
| 2714. | KHKIGLNNPKH; |
| 2715. | RHKIGLNNPKH; |
| 2716. | HHKIGLNNPKH; |
| 2717. | KKKIGLNNPKH; |
| 2718. | RKKIGLNNPKH; |
| 2719. | HKKIGLNNPKH; |
| 2720. | KRKIGLNNPKH; |
| 2721. | RRKIGLNNPKH; |
| 2722. | HRKIGLNNPKH; |
| 2723. | KHRIGLNNPKH; |
| 2724. | RHRIGLNNPKH; |
| 2725. | HHRIGLNNPKH; |
| 2726. | KKRIGLNNPKH; |
| 2727. | RKRIGLNNPKH; |
| 2728. | HKRIGLNNPKH; |
| 2729. | KRRIGLNNPKH; |
| 2730. | RRRIGLNNPKH; |
| 2731. | HRRIGLNNPKH; |
| 2732. | KHHVGLNNPKH; |
| 2733. | RHHVGLNNPKH; |
| 2734. | HHHVGLNNPKH; |
| 2735. | KKHVGLNNPKH; |
| 2736. | RKHVGLNNPKH; |
| 2737. | HKHVGLNNPKH; |
| 2738. | KRHVGLNNPKH; |
| 2739. | RRHVGLNNPKH; |
| 2740. | HRHVGLNNPKH; |
| 2741. | KHKVGLNNPKH; |
| 2742. | RHKVGLNNPKH; |
| 2743. | HHKVGLNNPKH; |
| 2744. | KKKVGLNNPKH; |
| 2745. | RKKVGLNNPKH; |
| 2746. | HKKVGLNNPKH; |
| 2747. | KRKVGLNNPKH; |
| 2748. | RRKVGLNNPKH; |
| 2749. | HRKVGLNNPKH; |
| 2750. | KHRVGLNNPKH; |
| 2751. | RHRVGLNNPKH; |
| 2752. | HHRVGLNNPKH; |
| 2753. | KKRVGLNNPKH; |
| 2754. | RKRVGLNNPKH; |
| 2755. | HKRVGLNNPKH; |
| 2756. | KRRVGLNNPKH; |
| 2757. | RRRVGLNNPKH; |
| 2758. | HRRVGLNNPKH; |
| 2759. | KHHLGINNPKH; |
| 2760. | RHHLGINNPKH; |
| 2761. | HHHLGINNPKH; |
| 2762. | KKHLGINNPKH; |
| 2763. | RKHLGINNPKH; |
| 2764. | HKHLGINNPKH; |
| 2765. | KRHLGINNPKH; |
| 2766. | RRHLGINNPKH; |
| 2767. | HRHLGINNPKH; |
| 2768. | KHKLGINNPKH; |
| 2769. | RHKLGINNPKH; |
| 2770. | HHKLGINNPKH; |
| 2771. | KKKLGINNPKH; |
| 2772. | RKKLGINNPKH; |
| 2773. | HKKLGINNPKH; |
| 2774. | KRKLGINNPKH; |
| 2775. | RRKLGINNPKH; |
| 2776. | HRKLGINNPKH; |
| 2777. | KHRLGINNPKH; |
| 2778. | RHRLGINNPKH; |
| 2779. | HHRLGINNPKH; |

TABLE 7-continued

SEQ ID NO. shown to left of sequence (cont'd)

| | |
|---|---|
| 2780. | KKRLGINNPKH; |
| 2781. | RKRLGINNPKH; |
| 2782. | HKRLGINNPKH; |
| 2783. | KRRLGINNPKH; |
| 2784. | RRRLGINNPKH; |
| 2785. | HRRLGINNPKH; |
| 2786. | KHHIGIENPKH; |
| 2787. | RHHIGINNPKH; |
| 2788. | HHHIGINNPKH; |
| 2789. | KKHIGINNPKH; |
| 2790. | RKHIGINNPKH; |
| 2791. | HKHIGINNPKH; |
| 2792. | KRHIGINNPKH; |
| 2793. | RRHIGINNPKH; |
| 2794. | HRHIGINNPKH; |
| 2795. | KHKIGINNPKH; |
| 2796. | RHKIGINNPKH; |
| 2797. | HHKIGINNPKH; |
| 2798. | KKKIGINNPKH; |
| 2799. | RKKIGINNPKH; |
| 2800. | HKKIGINNPKH; |
| 2801. | KRKIGINNPKH; |
| 2802. | RRKIGINNPKH; |
| 2803. | HRKIGINNPKH; |
| 2804. | KHRIGINNPKH; |
| 2805. | RHRIGINNPKH; |
| 2806. | HHRIGINNPKH; |
| 2807. | KKRIGINNPKH; |
| 2808. | RKRIGINNPKH; |
| 2809. | HKRIGINNPKH; |
| 2810. | KRRIGINNPKH; |
| 2811. | RRRIGINNPKH; |
| 2812. | HRRIGINNPKH; |
| 2813. | KHHVGINNPKH; |
| 2814. | RHHVGINNPKH; |
| 2815. | HHHVGINNPKH; |
| 2816. | KKHVGINNPKH; |
| 2817. | RKHVGINNPKH; |
| 2818. | HKHVGINNPKH; |
| 2819. | KRHVGINNPKH; |
| 2820. | RRHVGINNPKH; |
| 2821. | HRHVGINNPKH; |
| 2822. | KHKVGINNPKH; |
| 2823. | RHKVGINNPKH; |
| 2824. | HHKVGINNPKH; |
| 2825. | KKKVGINNPKH; |
| 2826. | RKKVGINNPKH; |
| 2827. | HKKVGINNPKH; |
| 2828. | KRKVGINNPKH; |
| 2829. | RRKVGINNPKH; |
| 2830. | HRKVGINNPKH; |
| 2831. | KHRVGINNPKH; |
| 2832. | RHRVGINNPKH; |
| 2833. | HHRVGINNPKH; |
| 2834. | KKRVGINNPKH; |
| 2835. | RKRVGINNPKH; |
| 2836. | HKRVGINNPKH; |
| 2837. | KRRVGINNPKH; |
| 2838. | RRRVGINNPKH; |
| 2839. | HRRVGINNPKH; |
| 2840. | KHHLGVNNPKH; |
| 2841. | RHHLGVNNPKH; |
| 2842. | HHHLGVNNPKH; |
| 2843. | KKHLGVNNPKH; |
| 2844. | RKHLGVNNPKH; |
| 2845. | HKHLGVNNPKH; |
| 2846. | KRHLGVNNPKH; |
| 2847. | RRHLGVNNPKH; |
| 2848. | HRHLGVNNPKH; |
| 2849. | KHKLGVNNPKH; |
| 2850. | RHKLGVNNPKH; |
| 2851. | HHKLGVNNPKH; |
| 2852. | KKKLGVNNPKH; |
| 2853. | RKKLGVNNPKH; |
| 2854. | HKKLGVNNPKH; |
| 2855. | KRKLGVNNPKH; |
| 2856. | RRKLGVNNPKH; |
| 2857. | HRKLGVNNPKH; |

TABLE 7-continued

SEQ ID NO. shown to left of sequence(cont'd)

| SEQ ID NO. | Sequence |
|---|---|
| 2858. | KHRLGVNNPKH; |
| 2859. | RHRLGVNNPKH; |
| 2860. | HHRLGVNNPKH; |
| 2861. | KKRLGVNNPKH; |
| 2862. | RKRLGVNNPKH; |
| 2863. | HKRLGVNNPKH; |
| 2864. | KRRLGVNNPKH; |
| 2865. | RRRLGVNNPKH; |
| 2866. | HRRLGVNNPKH; |
| 2867. | KHHIGVNNPKH; |
| 2868. | RHHIGVNNPKH; |
| 2869. | HHHIGVNNPKH; |
| 2870. | KKHIGVNNPKH; |
| 2871. | RKHIGVNNPKH; |
| 2872. | HKHIGVNNPKH; |
| 2873. | KRHIGVNNPKH; |
| 2874. | RRHIGVNNPKH; |
| 2875. | HRHIGVNNPKH; |
| 2876. | KHKIGVNNPKH; |
| 2877. | RHKIGVNNPKH; |
| 2878. | HHKIGVNNPKH; |
| 2879. | KKKIGVNNPKH; |
| 2880. | RKKIGVNNPKH; |
| 2881. | HKKIGVNNPKH; |
| 2882. | KRKIGVNNPKH; |
| 2883. | RRKIGVNNPKH; |
| 2884. | HRKIGVNNPKH; |
| 2885. | KHRIGVNNPKH; |
| 2886. | RHRIGVNNPKH; |
| 2887. | HHRIGVNNPKH; |
| 2888. | KKRIGVNNPKH; |
| 2889. | RKRIGVNNPKH; |
| 2890. | HKRIGVNNPKH; |
| 2891. | KRRIGVNNPKH; |
| 2892. | RRRIGVNNPKH; |
| 2893. | HRRIGVNNPKH; |
| 2894. | KHHVGVNNPKH; |
| 2895. | RHHVGVNNPKH; |
| 2896. | HHHVGVNNPKH; |
| 2897. | KKHVGVNNPKH; |
| 2898. | RKHVGVNNPKH; |
| 2899. | HKHVGVNNPKH; |
| 2900. | KRHVGVNNPKH; |
| 2901. | RRHVGVNNPKH; |
| 2902. | HRHVGVNNPKH; |
| 2903. | KHKVGVNNPKH; |
| 2904. | RHKVGVNNPKH; |
| 2905. | HHKVGVNNPKH; |
| 2906. | KKKVGVNNPKH; |
| 2907. | RKKVGVNNPKH; |
| 2908. | HKKVGVNNPKH; |
| 2909. | KRKVGVNNPKH; |
| 2910. | RRKVGVNNPKH; |
| 2911. | HRKVGVNNPKH; |
| 2912. | KHRVGVNNPKH; |
| 2913. | RHRVGVNNPKH; |
| 2914. | HHRVGVNNPKH; |
| 2915. | KKRVGVNNPKH; |
| 2916. | RKRVGVNNPKH; |
| 2917. | HKRVGVNNPKH; |
| 2918. | KRRVGVNNPKH; |
| 2919. | RRRVGVNNPKH; |
| 2920. | HRRVGVNNPKH; |
| 2921. | KHHLGLEEPRK; |
| 2922. | RHHLGLEEPRK; |
| 2923. | HHHLGLEEPRK; |
| 2924. | KKHLGLEEPRK; |
| 2925. | RKHLGLEEPRK; |
| 2926. | HKHLGLEEPRK; |
| 2927. | KRHLGLEEPRK; |
| 2928. | RRHLGLEEPRK; |
| 2929. | HRHLGLEEPRK; |
| 2930. | KHKLGLEEPRK; |
| 2931. | RHKLGLEEPRK; |
| 2932. | HHKLGLEEPRK; |
| 2933. | KKKLGLEEPRK; |
| 2934. | RKKLGLEEPRK; |
| 2935. | HKKLGLEEPRK; |

TABLE 7-continued

| SEQ ID NO. shown to left of sequence(cont'd) | |
|---|---|
| 2936. | KRKLGLEEPRK; |
| 2937. | RRKLGLEEPRK; |
| 2938. | HRKLGLEEPRK; |
| 2939. | KHRLGLEEPRK; |
| 2940. | RHRLGLEEPRK; |
| 2941. | HHRLGLEEPRK; |
| 2942. | KKRLGLEEPRK; |
| 2943. | RKRLGLEEPRK; |
| 2944. | HKRLGLEEPRK; |
| 2945. | KRRLGLEEPRK; |
| 2946. | RRRLGLEEPRK; |
| 2947. | HRRLGLEEPRK; |
| 2948. | KHHIGLEEPRK; |
| 2949. | RHHIGLEEPRK; |
| 2950. | HHHIGLEEPRK; |
| 2951. | KKHIGLEEPRK; |
| 2952. | RKHIGLEEPRK; |
| 2953. | HKHIGLEEPRK; |
| 2954. | KRHIGLEEPRK; |
| 2955. | RRHIGLEEPRK; |
| 2956. | HRHIGLEEPRK; |
| 2957. | KHKIGLEEPRK; |
| 2958. | RHKIGLEEPRK; |
| 2959. | HHKIGLEEPRK; |
| 2960. | KKKIGLEEPRK; |
| 2961. | RKKIGLEEPRK; |
| 2962. | HKKIGLEEPRK; |
| 2963. | KRKIGLEEPRK; |
| 2964. | RRKIGLEEPRK; |
| 2965. | HRKIGLEEPRK; |
| 2966. | KHRIGLEEPRK; |
| 2967. | RHRIGLEEPRK; |
| 2968. | HHRIGLEEPRK; |
| 2969. | KKRIGLEEPRK; |
| 2970. | RKRIGLEEPRK; |
| 2971. | HKRIGLEEPRK; |
| 2972. | KRRIGLEEPRK; |
| 2973. | RRRIGLEEPRK; |
| 2974. | HRRIGLEEPRK; |
| 2975. | KHHVGLEEPRK; |
| 2976. | RHHVGLEEPRK; |
| 2977. | HHHVGLEEPRK; |
| 2978. | KKHVGLEEPRK; |
| 2979. | RHHVGLEEPRK; |
| 2980. | HKHVGLEEPRK; |
| 2981. | KRHVGLEEPRK; |
| 2982. | RRHVGLEEPRK; |
| 2983. | HRHVGLEEPRK; |
| 2984. | KHKVGLEEPRK; |
| 2985. | RHKVGLEEPRK; |
| 2986. | HHKVGLEEPRK; |
| 2987. | KKKVGLEEPRK; |
| 2988. | RKKVGLEEPRK; |
| 2989. | HKKVGLEEPRK; |
| 2990. | KRKVGLEEPRK; |
| 2991. | RRKVGLEEPRK; |
| 2992. | HRKVGLEEPRK; |
| 2993. | KHRVGLEEPRK; |
| 2994. | RHRVGLEEPRK; |
| 2995. | HHRVGLEEPRK; |
| 2996. | KKRVGLEEPRK; |
| 2997. | RKRVGLEEPRK; |
| 2998. | HKRVGLEEPRK; |
| 2999. | KRRVGLEEPRK; |
| 3000. | RRRVGLEEPRK; |
| 3001. | HRRVGLEEPRK; |
| 3002. | KHHLGIEEPRK; |
| 3003. | RHHLGIEEPRK; |
| 3004. | HHHLGIEEPRK; |
| 3005. | KKHLGIEEPRK; |
| 3006. | RKHLGIEEPRK; |
| 3007. | HKHLGIEEPRK; |
| 3008. | KRHLGIEEPRK; |
| 3009. | RRHLGIEEPRK; |
| 3010. | HRHLGIEEPRK; |
| 3011. | KHKLGIEEPRK; |
| 3012. | RHKLGIEEPRK; |
| 3013. | HHKLGIEEPRK; |

TABLE 7-continued

SEQ ID NO. shown to left of sequence(cont'd)

| | |
|---|---|
| 3014. | KKKLGIEEPRK; |
| 3015. | RKKLGIEEPRK; |
| 3016. | HKKLGIEEPRK; |
| 3017. | KRKLGIEEPRK; |
| 3018. | RRKLGIEEPRK; |
| 3019. | HRKLGIEEPRK; |
| 3020. | KHRLGIEEPRK; |
| 3021. | RHRLGIEEPRK; |
| 3022. | HHRLGVEEPRK; |
| 3023. | KKRLGIEEPRK; |
| 3024. | RKRLGVEEPRK; |
| 3025. | HKRLGIEEPRK; |
| 3026. | KRRLGIEEPRK; |
| 3027. | RRRLGIEEPRK; |
| 3028. | HRRLGIEEPRK; |
| 3029. | KHHIGIEEPRK; |
| 3030. | RHHIGIEEPRK; |
| 3031. | HHHIGIEEPRK; |
| 3032. | KKHIGIEEPRK; |
| 3033. | RKHIGIEEPRK; |
| 3034. | HKHIGIEEPRK; |
| 3035. | KRHIGIEEPRK; |
| 3036. | RRHIGIEEPRK; |
| 3037. | HRHIGIEEPRK; |
| 3038. | KHKIGIEEPRK; |
| 3039. | RHKIGIEEPRK; |
| 3040. | HHKIGIEEPRK; |
| 3041. | KKKIGIEEPRK; |
| 3042. | RKKIGIEEPRK; |
| 3043. | HKKIGIEEPRK; |
| 3044. | KRKIGIEEPRK; |
| 3045. | RRKIGIEEPRK; |
| 3046. | HRKIGIEEPRK; |
| 3047. | KHRIGIEEPRK; |
| 3048. | RHRIGIEEPRK; |
| 3049. | HHRIGIEEPRK; |
| 3050. | KKRIGIEEPRK; |
| 3051. | RKRIGIEEPRK; |
| 3052. | HKRIGIEEPRK; |
| 3053. | KRRIGIEEPRK; |
| 3054. | RRRIGIEEPRK; |
| 3055. | HRRIGIEEPRK; |
| 3056. | KHHVGIEEPRK; |
| 3057. | RHHVGIEEPRK; |
| 3058. | HHHVGIEEPRK; |
| 3059. | KKHVGIEEPRK; |
| 3060. | RKHVGIEEPRK; |
| 3061. | HKHVGIEEPRK; |
| 3062. | KRHVGIEEPRK; |
| 3063. | RRHVGIEEPRK; |
| 3064. | HRHVGIEEPRK; |
| 3065. | KHKVGIEEPRK; |
| 3066. | RHKVGIEEPRK; |
| 3067. | HHKVGIEEPRK; |
| 3068. | KKKVGIEEPRK; |
| 3069. | RKKVGIEEPRK; |
| 3070. | HKKVGIEEPRK; |
| 3071. | KRKVGIEEPRK; |
| 3072. | RRKVGIEEPRK; |
| 3073. | HRKVGIEEPRK; |
| 3074. | KHRVGIEEPRK; |
| 3075. | RHRVGIEEPRK; |
| 3076. | HHRVGIEEPRK; |
| 3077. | KKRVGIEEPRK; |
| 3078. | RKRVGIEEPRK; |
| 3079. | HKRVGIEEPRK; |
| 3080. | KRRVGIEEPRK; |
| 3081. | RRRVGIEEPRK; |
| 3082. | HRRVGIEEPRK; |
| 3083. | KHHLGVEEPRK; |
| 3084. | RHHLGVEEPRK; |
| 3085. | HHHLGVEEPRK; |
| 3086. | KKHLGVEEPRK; |
| 3087. | RKHLGVEEPRK; |
| 3088. | HKHLGVEEPRK; |
| 3089. | KRHLGVEEPRK; |
| 3090. | RRHLGVEEPRK; |
| 3091. | HRHLGVEEPRK; |

TABLE 7-continued

SEQ ID NO. shown to left of sequence(cont'd)

| SEQ ID NO. | Sequence |
|---|---|
| 3092. | KHKLGVEEPRK; |
| 3093. | RHKLGVEEPRK; |
| 3094. | HHKLGVEEPRK; |
| 3095. | KKKLGVEEPRK; |
| 3096. | RKKLGVEEPRK; |
| 3097. | HKKLGVEEPRK; |
| 3098. | KRKLGVEEPRK; |
| 3099. | RRKLGVEEPRK; |
| 3100. | HRKLGVEEPRK; |
| 3101. | KHRLGVEEPRK; |
| 3102. | RHRLGVEEPRK; |
| 3103. | HHRLGVEEPRK; |
| 3104. | KKRLGVEEPRK; |
| 3105. | RKRLGVEEPRK; |
| 3106. | HKRLGVEEPRK; |
| 3107. | KRRLGVEEPRK; |
| 3108. | RRRLGVEEPRK; |
| 3109. | HRRLGVEEPRK; |
| 3110. | KHHIGVEEPRK; |
| 3111. | RHHIGVEEPRK; |
| 3112. | HHHIGVEEPRK; |
| 3113. | KKHIGVEEPRK; |
| 3114. | RKHIGVEEPRK; |
| 3115. | HKHIGVEEPRK; |
| 3116. | KRHIGVEEPRK; |
| 3117. | RRHIGVEEPRK; |
| 3118. | HRHIGVEEPRK; |
| 3119. | KHKIGVEEPRK; |
| 3120. | RHKIGVEEPRK; |
| 3121. | HHKIGVEEPRK; |
| 3122. | KKKIGVEEPRK; |
| 3123. | RKKIGVEEPRK; |
| 3124. | HKKIGVEEPRK; |
| 3125. | KRKIGVEEPRK; |
| 3126. | RRKIGVEEPRK; |
| 3127. | HRKIGVEEPRK; |
| 3128. | KHRIGVEEPRK; |
| 3129. | RHRIGVEEPRK; |
| 3130. | HHRIGVEEPRK; |
| 3131. | KKRIGVEEPRK; |
| 3132. | RKRIGVEEPRK; |
| 3133. | HKRIGVEEPRK; |
| 3134. | KRRIGVEEPRK; |
| 3135. | RRRIGVEEPRK; |
| 3136. | HRRIGVEEPRK; |
| 3137. | KHHVGVEEPRK; |
| 3138. | RHHVGVEEPRK; |
| 3139. | HHHVGVEEPRK; |
| 3140. | KKHVGVEEPRK; |
| 3141. | RKHVGVEEPRK; |
| 3142. | HKHVGVEEPRK; |
| 3143. | KRHVGVEEPRK; |
| 3144. | RRHVGVEEPRK; |
| 3145. | HRHVGVEEPRK; |
| 3146. | KHKVGVEEPRK; |
| 3147. | RHKVGVEEPRK; |
| 3148. | HHKVGVEEPRK; |
| 3149. | KKKVGVEEPRK; |
| 3150. | RKKVGVEEPRK; |
| 3151. | HKKVGVEEPRK; |
| 3152. | KRKVGVEEPRK; |
| 3153. | RRKVGVEEPRK; |
| 3154. | HRKVGVEEPRK; |
| 3155. | KHRVGVEEPRK; |
| 3156. | RHRVGVEEPRK; |
| 3157. | HHRVGVEEPRK; |
| 3158. | KKRVGVEEPRK; |
| 3159. | RKRVGVEEPRK; |
| 3160. | HKRVGVEEPRK; |
| 3161. | KRRVGVEEPRK; |
| 3162. | RRRVGVEEPRK; |
| 3163. | HRRVGVEEPRK; |
| 3164. | KHHLGLNEPRK; |
| 3165. | RHHLGLNEPRK; |
| 3166. | HHHLGLNEPRK; |
| 3167. | KKHLGLNEPRK; |
| 3168. | RKHLGLNEPRK; |
| 3169. | HKHLGLNEPRK; |

TABLE 7-continued

SEQ ID NO. shown to left of sequence (cont'd)

| SEQ ID NO. | Sequence |
|---|---|
| 3170. | KRHLGLNEPRK; |
| 3171. | RRHLGLNEPRK; |
| 3172. | HRHLGLNEPRK; |
| 3173. | KHKLGLNEPRK; |
| 3174. | RHKLGLNEPRK; |
| 3175. | HHKLGLNEPRK; |
| 3176. | KKKLGLNEPRK; |
| 3177. | RKKLGLNEPRK; |
| 3178. | HKKLGLNEPRK; |
| 3179. | KRKLGLNEPRK; |
| 3180. | RRKLGLNEPRK; |
| 3181. | HRKLGLNEPRK; |
| 3182. | KHRLGLNEPRK; |
| 3183. | RHRLGLNEPRK; |
| 3184. | HHRLGLNEPRK; |
| 3185. | KKRLGLNEPRK; |
| 3186. | RKRLGLNEPRK; |
| 3187. | HKRLGLNEPRK; |
| 3188. | KRRLGLNEPRK; |
| 3189. | RRRLGLNEPRK; |
| 3190. | HRRLGLNEPRK; |
| 3191. | KHHIGLNPRK; |
| 3192. | RHHIGLNEPRK; |
| 3193. | HHHIGLNEPRK; |
| 3194. | KKHIGLNEPRK; |
| 3195. | RKHIGLNEPRK; |
| 3196. | HKHIGLNEPRK; |
| 3197. | KRHIGLNEPRK; |
| 3198. | RRHIGLNEPRK; |
| 3199. | HRHIGLNEPRK; |
| 3200. | KHKIGLNEPRK; |
| 3201. | RHKIGLNEPRK; |
| 3202. | HHHIGLNEPRK; |
| 3203. | KKKIGLNEPRK; |
| 3204. | RKKIGLNEPRK; |
| 3205. | HKKIGLNEPRK; |
| 3206. | KRKIGLNEPRK; |
| 3207. | RRKIGLNEPRK; |
| 3208. | HRKIGLNEPRK; |
| 3209. | KHRIGLNEPRK; |
| 3210. | RHRIGLNEPRK; |
| 3211. | HHRIGLNEPRK; |
| 3212. | KKRIGLNEPRK; |
| 3213. | RKRIGLNEPRK; |
| 3214. | HKRIGLNEPRK; |
| 3215. | KRRIGLNEPRK; |
| 3216. | RRRIGLNEPRK; |
| 3217. | HRRIGLNEPRK; |
| 3218. | KHHVGLNEPRK; |
| 3219. | RHHVGLNEPRK; |
| 3220. | HHHVGLNEPRK; |
| 3221. | KKHVGLNEPRK; |
| 3222. | RKHVGLNEPRK; |
| 3223. | HKHVGLNEPRK; |
| 3224. | KRHVGLNEPRK; |
| 3225. | RRHVGLNEPRK; |
| 3226. | HRHVGLNEPRK; |
| 3227. | KHKVGLNEPRK; |
| 3228. | RHKVGLNEPRK; |
| 3229. | HHKVGLNEPRK; |
| 3230. | KKKVGLNEPRK; |
| 3231. | RKKVGLNEPRK; |
| 3232. | HKKVGLNEPRK; |
| 3233. | KRKVGLNEPRK; |
| 3234. | RRKVGLNEPRK; |
| 3235. | HRKVGLNEPRK; |
| 3236. | KHRVGLNEPRK; |
| 3237. | RHRVGLNEPRK; |
| 3238. | HHRVGLNEPRK; |
| 3239. | KKRVGLNEPRK; |
| 3240. | RKRVGLNEPRK; |
| 3241. | HKRVGLNEPRK; |
| 3242. | KRRVGLNEPRK; |
| 3243. | RRRVGLNEPRK; |
| 3244. | HRRVGLNEPRK; |
| 3245. | KHHLGINEPRK; |
| 3246. | RHHLGINEPRK; |
| 3247. | HHHLGINEPRK; |

TABLE 7-continued

SEQ ID NO. shown to left of sequence(cont'd)

| SEQ ID NO. | Sequence |
|---|---|
| 3248. | KKHLGINEPRK; |
| 3249. | RKHLGINEPRK; |
| 3250. | HKHLGINEPRK; |
| 3251. | KRHLGINEPRK; |
| 3252. | RRHLGINEPRK; |
| 3253. | HRHLGINEPRK; |
| 3254. | KHKLGINEPRK; |
| 3255. | RHKLGINEPRK; |
| 3256. | HHKLGINEPRK; |
| 3257. | KKKLGINEPRK; |
| 3258. | RKKLGINEPRK; |
| 3259. | HKKLGINEPRK; |
| 3260. | KRKLGINEPRK; |
| 3261. | RRKLGINEPRK; |
| 3262. | HRKLGINEPRK; |
| 3263. | KHRLGINEPRK; |
| 3264. | RHRLGINEPRK; |
| 3265. | HHRLGINEPRK; |
| 3266. | KKRLGINEPRK; |
| 3267. | RKRLGINEPRK; |
| 3268. | HKRLGINEPRK; |
| 3269. | KRRLGINEPRK; |
| 3270. | RRRLGINEPRK; |
| 3271. | HRRLGINEPRK; |
| 3272. | KHHIGIENPRK; |
| 3273. | RHHIGINEPRK; |
| 3274. | HHHIGINEPRK; |
| 3275. | KKHIGINEPRK; |
| 3276. | RKHIGINEPRK; |
| 3277. | HKHIGINEPRK; |
| 3278. | KRHIGINEPRK; |
| 3279. | RRHIGINEPRK; |
| 3280. | HRHIGINEPRK; |
| 3281. | KHKIGINEPRK; |
| 3282. | RHKIGINEPRK; |
| 3283. | HHKIGINEPRK; |
| 3284. | KKKIGINEPRK; |
| 3285. | RKKIGINEPRK; |
| 3286. | HKKIGINEPRK; |
| 3287. | KRKIGINEPRK; |
| 3288. | RRKIGINEPRK; |
| 3289. | HRKIGINEPRK; |
| 3290. | KHRIGINEPRK; |
| 3291. | RHRIGINEPRK; |
| 3292. | HHRIGINEPRK; |
| 3293. | KKRIGINEPRK; |
| 3294. | RKRIGINEPRK; |
| 3295. | HKRIGINEPRK; |
| 3296. | KRRIGINEPRK; |
| 3297. | RRRIGINEPRK; |
| 3298. | HRRIGINEPRK; |
| 3299. | KHHVGINEPRK; |
| 3300. | RHHVGINEPRK; |
| 3301. | HHHVGINEPRK; |
| 3302. | KKHVGINEPRK; |
| 3303. | RKHVGINEPRK; |
| 3304. | HKHVGINEPRK; |
| 3305. | KRHVGINEPRK; |
| 3306. | RRHVGINEPRK; |
| 3307. | HRHVG1NEPRK; |
| 3308. | KHKVGINEPRK; |
| 3309. | RHKVGINEPRK; |
| 3310. | HHKVGINEPRK; |
| 3311. | KKKVGINEPRK; |
| 3312. | RKKVGINEPRK; |
| 3313. | HKKVGINEPRK; |
| 3314. | KRKVGINEPRK; |
| 3315. | RRKVGINEPRK; |
| 3316. | HRKVGINEPRK; |
| 3317. | KHRVGINEPRK; |
| 3318. | RHRVGINEPRK; |
| 3319. | HHRVGINEPRK; |
| 3320. | KKRVGINEPRK; |
| 3321. | RKRVGINEPRK; |
| 3322. | HKRVGINEPRK; |
| 3323. | KRRVGINEPRK; |
| 3324. | RRRVGINEPRK; |
| 3325. | HRRVGINEPRK; |

TABLE 7-continued

SEQ ID NO. shown to left of sequence(cont'd)

| | |
|---|---|
| 3326. | KHHLGVNEPRK; |
| 3327. | RHHLGVNEPRK; |
| 3328. | HHHLGVNEPRK; |
| 3329. | KKHLGVNEPRK; |
| 3330. | RKHLGVNEPRK; |
| 3331. | HKHLGVNEPRK; |
| 3332. | KRHLGVNEPRK; |
| 3333. | RRHLGVNEPRK; |
| 3334. | HRHLGVNEPRK; |
| 3335. | KHKLGVNEPRK; |
| 3336. | RHKLGVNEPRK; |
| 3337. | HHKLGVNEPRK; |
| 3338. | KKKLGVNEPRK; |
| 3339. | RKKLGVNEPRK; |
| 3340. | HKKLGVNEPRK; |
| 3341. | KRKLGVNEPRK; |
| 3342. | RRKLGVNEPRK; |
| 3343. | HRKLGVNEPRK; |
| 3344. | KHRLGVNEPRK; |
| 3345. | RHRLGVNEPRK; |
| 3346. | HHRLGVNEPRK; |
| 3347. | KKRLGVNEPRK; |
| 3348. | RKRLGVNEPRK; |
| 3349. | HKRLGVNEPRK; |
| 3350. | KRRLGVNEPRK; |
| 3351. | RRRLGVNEPRK; |
| 3352. | HRRLGVNEPRK; |
| 3353. | KHHIGVNEPRK; |
| 3354. | RHHIGVNEPRK; |
| 3355. | HHHIGVNEPRK; |
| 3356. | KKHIGVNEPRK; |
| 3357. | RKHIGVNEPRK; |
| 3358. | HKHIGVNEPRK; |
| 3359. | KRHIGVNEPRK; |
| 3360. | RRHIGVNEPRK; |
| 3361. | HRHIGVNEPRK; |
| 3362. | KHKIGVNEPRK; |
| 3363. | RHKIGVNEPRK; |
| 3364. | HHKIGVNEPRK; |
| 3365. | KKKIGVNEPRK; |
| 3366. | RKKIGVNEPRK; |
| 3367. | HKKIGVNEPRK; |
| 3368. | KRKIGVNEPRK; |
| 3369. | RRKIGVNEPRK; |
| 3370. | HRKIGVNEPRK; |
| 3371. | KHRIGVNEPRK; |
| 3372. | RHRIGVNEPRK; |
| 3373. | HHRIGVNEPRK; |
| 3374. | KKRIGVNEPRK; |
| 3375. | RKRIGVNEPRK; |
| 3376. | HKRIGVNEPRK; |
| 3377. | KRRIGVNEPRK; |
| 3378. | RRRIGVNEPRK; |
| 3379. | HRRIGVNEPRK; |
| 3380. | KHHVGVNEPRK; |
| 3381. | RHHVGVNEPRK; |
| 3382. | HHHVGVNEPRK; |
| 3383. | KHHVGVNEPRK; |
| 3384. | RKHVGVNEPRK; |
| 3385. | HKHVGVNEPRK; |
| 3386. | KRHVGVNEPRK; |
| 3387. | RRHVGVNEPRK; |
| 3388. | HRHVGVNEPRK; |
| 3389. | KHKVGVNEPRK; |
| 3390. | RHKVGVNEPRK; |
| 3391. | HHKVGVNEPRK; |
| 3392. | KKKVGVNEPRK; |
| 3393. | RKKVGVNEPRK; |
| 3394. | HKKVGVNEPRK; |
| 3395. | KRKVGVNEPRK; |
| 3396. | RRKVGVNEPRK; |
| 3397. | HRKVGVNEPRK; |
| 3398. | KHRVGVNEPRK; |
| 3399. | RHRVGVNEPRK; |
| 3400. | HHRVGVNEPRK; |
| 3401. | KKRVGVNEPRK; |
| 3402. | RKRVGVNEPRK; |
| 3403. | HKRVGVNEPRK; |

TABLE 7-continued

| SEQ ID NO. shown to left of sequence(cont'd) | |
|---|---|
| 3404. | KRRVGVNEPRK; |
| 3405. | RRRVGVNEPRK; |
| 3406. | HRRVGVNEPRK; |
| 3407. | KHHLGLENPRK; |
| 3408. | RHHLGLENPRK; |
| 3409. | HHHLGLENPRK; |
| 3410. | KKHLGLENPRK; |
| 3411. | RKHLGLENPRK; |
| 3412. | HKHLGLENPRK; |
| 3413. | KRHLGLENPRK; |
| 3414. | RRHLGLENPRK; |
| 3415. | HRHLGLENPRK; |
| 3416. | KHKLGLENPRK; |
| 3417. | RHKLGLENPRK; |
| 3418. | HHKLGLENPRK; |
| 3419. | KKKLGLENPRK; |
| 3420. | RKKLGLENPRK; |
| 3421. | HKKLGLENPRK; |
| 3422. | KRKLGLENPRK; |
| 3423. | RRKLGLENPRK; |
| 3424. | HRKLGLENPRK; |
| 3425. | KHRLGLENPRK; |
| 3426. | RHRLGLENPRK; |
| 3427. | HHRLGLENPRK; |
| 3428. | KKRLGLENPRK; |
| 3429. | RKRLGLENPRK; |
| 3430. | HKRLGLENPRK; |
| 3431. | KRRLGLENPRK; |
| 3432. | RRRLGLENPRK; |
| 3433. | HRRLGLENPRK; |
| 3434. | KHHIGLENPRK; |
| 3435. | RHHIGLENPRK; |
| 3436. | HHHIGLENPRK; |
| 3437. | KKHIGLENPRK; |
| 3438. | RKHIGLENPRK; |
| 3439. | HKHIGLENPRK; |
| 3440. | KRHIGLENPRK; |
| 3441. | RRHIGLENPRK; |
| 3442. | HRHIGLENPRK; |
| 3443. | KHKIGLENPRK; |
| 3444. | RHKIGLENPRK; |
| 3445. | HHKIGLENPRK; |
| 3446. | KKKIGLENPRK; |
| 3447. | RKKIGLENPRK; |
| 3448. | HKKIGLENPRK; |
| 3449. | KRKIGLENPRK; |
| 3450. | RRKIGLENPRK; |
| 3451. | HRKIGLENPRK; |
| 3452. | KHRIGLENPRK; |
| 3453. | RHRIGLENPRK; |
| 3454. | HHRIGLENPRK; |
| 3455. | KKRIGLENPRK; |
| 3456. | RKRIGLENPRK; |
| 3457. | HKRIGLENPRK; |
| 3458. | KRRIGLENPRK; |
| 3459. | RRRIGLENPRK; |
| 3460. | HRRIGLENPRK; |
| 3461. | KHHVGLENPRK; |
| 3462. | RHHVGLENPRK; |
| 3463. | HHHVGLENPRK; |
| 3464. | KKHVGLENPRK; |
| 3465. | RKHVGLENPRK; |
| 3466. | HKHVGLENPRK; |
| 3467. | KRHVGLENPRK; |
| 3468. | RRHVGLENPRK; |
| 3469. | HRHVGLENPRK; |
| 3470. | KHKVGLENPRK; |
| 3471. | RHKVGLENPRK; |
| 3472. | HHKVGLENPRK; |
| 3473. | KKKVGLENPRK; |
| 3474. | RKKVGLENPRK; |
| 3475. | HKKVGLENPRK; |
| 3476. | KRKVGLENPRK; |
| 3477. | RRKVGLENPRK; |
| 3478. | HRKVGLENPRK; |
| 3479. | KHRVGLENPRK; |
| 3480. | RHRVGLENPRK; |
| 3481. | HHRVGLENPRK; |

TABLE 7-continued

SEQ ID NO. shown to left of sequence(cont'd)

| | |
|---|---|
| 3482. | KKRVGLENPRK; |
| 3483. | RKRVGLENPRK; |
| 3484. | HKRVGLENPRK; |
| 3485. | KRRVGLENPRK; |
| 3486. | RRRVGLENPRK; |
| 3487. | HRRVGLENPRK; |
| 3488. | KHHLGIENPRK; |
| 3489. | RHHLGIENPRK; |
| 3490. | HHHLGIENPRK; |
| 3491. | KKHLGIENPRK; |
| 3492. | RKHLGIENPRK; |
| 3493. | HKHLGIENPRK; |
| 3494. | KRHLGIENPRK; |
| 3495. | RRHLGIENPRK; |
| 3496. | HRHLGIENPRK; |
| 3497. | KHKLGIENPRK; |
| 3498. | RHKLGIENPRK; |
| 3499. | HHKLGIENPRK; |
| 3500. | KKKLGIENPRK; |
| 3501. | RKKLGIENPRK; |
| 3502. | HKKLGIENPRK; |
| 3503. | KRKLGIENPRK; |
| 3504. | RRKLGIENPRK; |
| 3505. | HRKLGIENPRK; |
| 3506. | KHRLGIENPRK; |
| 3507. | RHRLGIENPRK; |
| 3508. | HHRLGIENPRK; |
| 3509. | KKRLGIENPRK; |
| 3510. | RKRLGIENPRK; |
| 3511. | HKRLGIENPRK; |
| 3512. | KRRLGIENPRK; |
| 3513. | RRRLGIENPRK; |
| 3514. | HRRLGIENPRK; |
| 3515. | KHHIGIENPRK; |
| 3516. | RHHIGIENPRK; |
| 3517. | HHHIGIENPRK; |
| 3518. | KKHIGIENPRK; |
| 3519. | RKHIGIENPRK; |
| 3520. | HKHIGIENPRK; |

TABLE 7-continued

SEQ ID NO. shown to left of sequence(cont'd)

| | |
|---|---|
| 3521. | KRHIGIENPRK; |
| 3522. | RRHIGIENPRK; |
| 3523. | HRHIGIENPRK; |
| 3524. | KHKIGIENPRK; |
| 3525. | RHKIGIENPRK; |
| 3526. | HHKIGIENPRK; |
| 3527. | KKKIGIENPRK; |
| 3528. | RKKIGIENPRK; |
| 3529. | HKKIGIENPRK; |
| 3530. | KRKIGIENPRK; |
| 3531. | RRKIGIENPRK; |
| 3532. | HRKIGIENPRK; |
| 3533. | KHRIGIENPRK; |
| 3534. | RHRIGIENPRK; |
| 3535. | HHRIGIENPRK; |
| 3536. | KKRIGIENPRK; |
| 3537. | RKRIGIENPRK; |
| 3538. | HKRIGIENPRK; |
| 3539. | KRRIGIENPRK; |
| 3540. | RRRIGIENPRK; |
| 3541. | HRRIGIENPRK; |
| 3542. | KHHVGIENPRK; |
| 3543. | RHHVGIENPRK; |
| 3544. | HHHVGIENPRK; |
| 3545. | KKHVGIENPRK; |
| 3546. | RKHVGIENPRK; |
| 3547. | HKHVGIENPRK; |
| 3548. | KRHVGIENPRK; |
| 3549. | RRHVGIENPRK; |
| 3550. | HRHVGIENPRK; |
| 3551. | KHKVGIENPRK; |
| 3552. | RHKVGIENPRK; |
| 3553. | HHKVGIENPRK; |
| 3554. | KKKVGIENPRK; |
| 3555. | RKKVGIENPRK; |
| 3556. | HKKVGIENPRK; |
| 3557. | KRKVGIENPRK; |
| 3558. | RRKVGIENPRK; |
| 3559. | HRKVGIENPRK; |

TABLE 7-continued

SEQ ID NO. shown to left of sequence(cont'd)

| SEQ ID NO. | Sequence |
|---|---|
| 3560. | KHRVGIENPRK; |
| 3561. | RHRVGIENPRK; |
| 3562. | HHRVGIENPRK; |
| 3563. | KKRVGIENPRK; |
| 3564. | RKRVGIENPRK; |
| 3565. | HKRVGIENPRK; |
| 3566. | KRRVGIENPRK; |
| 3567. | RRRVGIENPRK; |
| 3568. | HRRVGIENPRK; |
| 3569. | KHHLGVENPRK; |
| 3570. | RHHLGVENPRK; |
| 3571. | HHHLGVENPRK; |
| 3572. | KKHLGVENPRK; |
| 3573. | RKHLGVENPRK; |
| 3574. | HKHLGVENPRK; |
| 3575. | KRHLGVENPRK; |
| 3576. | RRHLGVENPRK; |
| 3577. | HRHLGVENPRK; |
| 3578. | KHKLGVENPRK; |
| 3579. | RHKLGVENPRK; |
| 3580. | HHKLGVENPRK; |
| 3581. | KKKLGVENPRK; |
| 3582. | RKKLGVENPRK; |
| 3583. | HKKLGVENPRK; |
| 3584. | KRKLGVENPRK; |
| 3585. | RRKLGVENPRK; |
| 3586. | HRKLGVENPRK; |
| 3587. | KHRLGVENPRK; |
| 3588. | RHRLGVENPRK; |
| 3589. | HHRLGVENPRK; |
| 3590. | KKRLGVENPRK; |
| 3591. | RKRLGVENPRK; |
| 3592. | HKRLGVENPRK; |
| 3593. | KRRLGVENPRK; |
| 3594. | RRRLGVENPRK; |
| 3595. | HRRLGVENPRK; |
| 3596. | KHHIGVENPRK; |
| 3597. | RHHIGVEEPRK; |
| 3598. | HHHIGVENPRK; |
| 3599. | KKHIGVENPRK; |
| 3600. | RKHIGVENPRK; |
| 3601. | HKHIGVENPRK; |
| 3602. | KRHIGVENPRK; |
| 3603. | RRHIGVENPRK; |
| 3604. | HRHIGVENPRK; |
| 3605. | KHKIGVENPRK; |
| 3606. | RHKIGVENPRK; |
| 3607. | HHKIGVENPRK; |
| 3608. | KKKIGVENPRK; |
| 3609. | RKKIGVENPRK; |
| 3610. | HKKIGVENPRK; |
| 3611. | KRKIGVENPRK; |
| 3612. | RRKIGVENPRK; |
| 3613. | HRKIGVENPRK; |
| 3614. | KHRIGVENPRK; |
| 3615. | RHRIGVENPRK; |
| 3616. | HHRIGVENPRK; |
| 3617. | KKRIGVENPRK; |
| 3618. | RKRIGVENPRK; |
| 3619. | HKRIGVENPRK; |
| 3620. | KRRIGVENPRK; |
| 3621. | RRRIGVENPRK; |
| 3622. | HRRIGVENPRK; |
| 3623. | KHHVGVENPRK; |
| 3624. | RHHVGVENPRK; |
| 3625. | HHHVGVENPRK; |
| 3626. | KKHVGVENPRK; |
| 3627. | RKHVGVENPRK; |
| 3628. | HKHVGVENPRK; |
| 3629. | KRHVGVENPRK; |
| 3630. | RRHVGVENPRK; |
| 3631. | HRHVGVENPRK; |
| 3632. | KHKVGVENPRK; |
| 3633. | RHKVGVENPRK; |
| 3634. | HHKVGVENPRK; |
| 3635. | KKKVGVENPRK; |
| 3636. | RKKVGVENPRK; |
| 3637. | HKKVGVENPRK; |

TABLE 7-continued

SEQ ID NO. shown to left of sequence(cont'd)

| SEQ ID | Sequence |
|---|---|
| 3638. | KRKVGVENPRK; |
| 3639. | RRKVGVEEPRK; |
| 3640. | HRKVGVENPRK; |
| 3641. | KHRVGVENPRK; |
| 3642. | RHRVGVENPRK; |
| 3643. | HHRVGVENPRK; |
| 3644. | KKRVGVENPRK; |
| 3645. | RKRVGVENPRK; |
| 3646. | HKRVGVENPRK; |
| 3647. | KRRVGVENPRK; |
| 3648. | RRRVGVENPRK; |
| 3649. | HRRVGVENPRK; |
| 3650. | KHHLGLNNPRK; |
| 3651. | RHHLGLNNPRK; |
| 3652. | HHHLGLNNPRK; |
| 3653. | KKHLGLNNPRK; |
| 3654. | RKHLGLNNPRK; |
| 3655. | HKHLGLNNPRK; |
| 3656. | KRHLGLNNPRK; |
| 3657. | RRHLGLNNPRK; |
| 3658. | HRHLGLNNPRK; |
| 3659. | KHKLGLNNPRK; |
| 3660. | RHKLGLNNPRK; |
| 3661. | HHKLGLNNPRK; |
| 3662. | KKKLGLNNPRK; |
| 3663. | RKKLGLNNPRK; |
| 3664. | HKKLGLNNPRK; |
| 3665. | KRKLGLNNPRK; |
| 3666. | RRKLGLNNPRK; |
| 3667. | HRKLGLNNPRK; |
| 3668. | KHRLGLNNPRK; |
| 3669. | RHRLGLNNPRK; |
| 3670. | HHRLGLNNPRK; |
| 3671. | KKRLGLNNPRK; |
| 3672. | RKRLGLNNPRK; |
| 3673. | HKRLGLNNPRK; |
| 3674. | KRRLGLNNPRK; |
| 3675. | RRRLGLNNPRK; |
| 3676. | HRRLGLNNPRK; |
| 3677. | KHHIGLNNPRK; |
| 3678. | RHHIGLNNPRK; |
| 3679. | HHHIGLNNPRK; |
| 3680. | KKHIGLNNPRK; |
| 3681. | RKHIGLNNPRK; |
| 3682. | HKHIGLNNPRK; |
| 3683. | KRHIGLNNPRK; |
| 3684. | RRHIGLNNPRK; |
| 3685. | HRHIGLNNPRK; |
| 3686. | KHKIGLNNPRK; |
| 3687. | RHKIGLNNPRK; |
| 3688. | HHKIGLNNPRK; |
| 3689. | KKKIGLNNPRK; |
| 3690. | RKKIGLNNPRK; |
| 3691. | HKKIGLNNPRK; |
| 3692. | KRKIGLNNPRK; |
| 3693. | RRKIGLNNPRK; |
| 3694. | HRKIGLNNPRK; |
| 3695. | KHRIGLNNPRK; |
| 3696. | RHRIGLNNPRK; |
| 3697. | HHRIGLNNPRK; |
| 3698. | KKRIGLNNPRK; |
| 3699. | RKRIGLNNPRK; |
| 3700. | HKRIGLNNPRK; |
| 3701. | KRRIGLNNPRK; |
| 3702. | RRRIGLNNPRK; |
| 3703. | HRRIGLNNPRK; |
| 3704. | KHHVGLNNPRK; |
| 3705. | RHHVGLNNPRK; |
| 3706. | HHHVGLNNPRK; |
| 3707. | KKHVGLNNPRK; |
| 3708. | RKHVGLNNPRK; |
| 3709. | HKHVGLNNPRK; |
| 3710. | KRHVGLNNPRK; |
| 3711. | RRHVGLNNPRK; |
| 3712. | HRHVGLNNPRK; |
| 3713. | KHKVGLNNPRK; |
| 3714. | RHKVGLNNPRK; |
| 3715. | HHKVGLNNPRK; |

TABLE 7-continued

SEQ ID NO. shown to left of sequence(cont'd)

| | |
|---|---|
| 3716. | KKKVGLNNPRK; |
| 3717. | RKKVGLNNPRK; |
| 3718. | HKKVGLNNPRK; |
| 3719. | KRKVGLNNPRK; |
| 3720. | RRKVGLNNPRK; |
| 3721. | HRKVGLNNPRK; |
| 3722. | KHRVGLNNPRK; |
| 3723. | RHRVGLNNPRK; |
| 3724. | HHRVGLNNPRK; |
| 3725. | KKRVGLNNPRK; |
| 3726. | RKRVGLNNPRK; |
| 3727. | HKRVGLNNPRK; |
| 3728. | KRRVGLNNPRK; |
| 3729. | RRRVGLNNPRK; |
| 3730. | HRRVGLNNPRK; |
| 3731. | KHHLGINNPRK; |
| 3732. | RHHLGINNPRK; |
| 3733. | HHHLGINNPRK; |
| 3734. | KKHLGINNPRK; |
| 3735. | RKHLGINNPRK; |
| 3736. | HKHLGINNPRK; |
| 3737. | KRHLGINNPRK; |
| 3738. | RRHLGINNPRK; |
| 3739. | HRHLGINNPRK; |
| 3740. | KHKLGINNPRK; |
| 3741. | RHKLGINNPRK; |
| 3742. | HHKLGINNPRK; |
| 3743. | KKKLGINNPRK; |
| 3744. | RKKLGINNPRK; |
| 3745. | HKKLGINNPRK; |
| 3746. | KRKLGINNPRK; |
| 3747. | RRKLGINNPRK; |
| 3748. | HRKLGINNPRK; |
| 3749. | KHRLGINNPRK; |
| 3750. | RHRLGINNPRK; |
| 3751. | HHRLGINNPRK; |
| 3752. | KKRLGINNPRK; |
| 3753. | RKRLGINNPRK; |
| 3754. | HKRLGINNPRK; |

TABLE 7-continued

SEQ ID NO. shown to left of sequence(cont'd)

| | |
|---|---|
| 3755. | KRRLGINNPRK; |
| 3756. | RRRLGINNPRK; |
| 3757. | HRRLGINNPRK; |
| 3758. | KHHIGIENPRK; |
| 3759. | RHHIGINNPRK; |
| 3760. | HHHIGINNPRK; |
| 3761. | KKHIGINNPRK; |
| 3762. | RKHIGINNPRK; |
| 3763. | HKHIGINNPRK; |
| 3764. | KRHIGINNPRK; |
| 3765. | RRHIGINNPRK; |
| 3766. | HRHIGINNPRK; |
| 3767. | KHKIGINNPRK; |
| 3768. | RHKIGINNPRK; |
| 3769. | HHKIGINNPRK; |
| 3770. | KKKIGINNPRK; |
| 3771. | RKKIGINNPRK; |
| 3772. | HKKIGINNPRK; |
| 3773. | KRKIGINNPRK; |
| 3774. | RRKIGINNPRK; |
| 3775. | HRKIGINNPRK; |
| 3776. | KHRIGINNPRK; |
| 3777. | RHRIGINNPRK; |
| 3778. | HHRIGINNPRK; |
| 3779. | KKRIGINNPRK; |
| 3780. | RKRIGINNPRK; |
| 3781. | HKRIGINNPRK; |
| 3782. | KRRIGINNPRK; |
| 3783. | RRRIGINNPRK; |
| 3784. | HRRIGINNPRK; |
| 3785. | KHHVGINNPRK; |
| 3786. | RHHVGINNPRK; |
| 3787. | HHHVGINNPRK; |
| 3788. | KKHVGINNPRK; |
| 3789. | RKHVGINNPRK; |
| 3790. | HKHVGINNPRK; |
| 3791. | KRHVGINNPRK; |
| 3792. | RRHVGINNPRK; |
| 3793. | HRHVGINNPRK; |

TABLE 7-continued

SEQ ID NO. shown to left of sequence(cont'd)

| | |
|---|---|
| 3794. | KHKVGINNPRK; |
| 3795. | RHKVGINNPRK; |
| 3796. | HHKVGINNPRK; |
| 3797. | KKKVGINNPRK; |
| 3798. | RKKVGINNPRK; |
| 3799. | HKKVGINNPRK; |
| 3800. | KRKVGINNPRK; |
| 3801. | RRKVGINNPRK; |
| 3802. | HRKVGINNPRK; |
| 3803. | KHRVGINNPRK; |
| 3804. | RHRVGINNPRK; |
| 3805. | HHRVGINNPRK; |
| 3806. | KKRVGINNPRK; |
| 3807. | RKRVGINNPRK; |
| 3808. | HKRVGINNPRK; |
| 3809. | KRRVGINNPRK; |
| 3810. | RRRVGINNPRK; |
| 3811. | HRRVGINNPRK; |
| 3812. | KHHLGVNNPRK; |
| 3813. | RHHLGVNNPRK; |
| 3814. | HHHLGVNNPRK; |
| 3815. | KKHLGVNNPRK; |
| 3816. | RKHLGVNNPRK; |
| 3817. | HKHLGVNNPRK; |
| 3818. | KRHLGVNNPRK; |
| 3819. | RRHLGVNNPRK; |
| 3820. | HRHLGVNNPRK; |
| 3821. | KHKLGVNNPRK; |
| 3822. | RHKLGVNNPRK; |
| 3823. | HHKLGVNNPRK; |
| 3824. | KKKLGVNNPRK; |
| 3825. | RKKLGVNNPRK; |
| 3826. | HKKLGVNNPRK; |
| 3827. | KRKLGVNNPRK; |
| 3828. | RRKLGVNNPRK; |
| 3829. | HRKLGVNNPRK; |
| 3830. | KHRLGVNNPRK; |
| 3831. | RHRLGVNNPRK; |
| 3832. | HHRLGVNNPRK; |
| 3833. | KKRLGVNNPRK; |
| 3834. | RKRLGVNNPRK; |
| 3835. | HKRLGVNNPRK; |
| 3836. | KRRLGVNNPRK; |
| 3837. | RRRLGVNNPRK; |
| 3838. | HRRLGVNNPRK; |
| 3839. | KHHIGVNNPRK; |
| 3840. | RHHIGVNNPRK; |
| 3841. | HHHIGVNNPRK; |
| 3842. | KKHIGVNNPRK; |
| 3843. | RKHIGVNNPRK; |
| 3844. | HKHIGVNNPRK; |
| 3845. | KRHIGVNNPRK; |
| 3846. | RRHIGVNNPRK; |
| 3847. | HRHIGVNNPRK; |
| 3848. | KHKIGVNNPRK; |
| 3849. | RHKIGVNNPRK; |
| 3850. | HHKIGVNNPRK; |
| 3851. | KKKIGVNNPRK; |
| 3852. | RKKIGVNNPRK; |
| 3853. | HKKIGVNNPRK; |
| 3854. | KRKIGVNNPRK; |
| 3855. | RRKIGVNNPRK; |
| 3856. | HRKIGVNNPRK; |
| 3857. | KHRIGVNNPRK; |
| 3858. | RHRIGVNNPRK; |
| 3859. | HHRIGVNNPRK; |
| 3860. | KKRIGVNNPRK; |
| 3861. | RKRIGVNNPRK; |
| 3862. | HKRIGVNNPRK; |
| 3863. | KRRIGVNNPRK; |
| 3864. | RRRIGVNNPRK; |
| 3865. | HRRIGVNNPRK; |
| 3866. | KHHVGVNNPRK; |
| 3867. | RHHVGVNNPRK; |
| 3868. | HHHVGVNNPRK; |
| 3869. | KKHVGVNNPRK; |
| 3870. | RKHVGVNNPRK; |
| 3871. | HKHVGVNNPRK; |

TABLE 7-continued

SEQ ID NO. shown to left of sequence(cont'd)

| | |
|---|---|
| 3872. | KRHVGVNNPRK; |
| 3873. | RRHVGVNNPRK; |
| 3874. | HRHVGVNNPRK; |
| 3875. | KHKVGVNNPRK; |
| 3876. | RHKVGVNNPRK; |
| 3877. | HHKVGVNNPRK; |
| 3878. | KKKVGVNNPRK; |
| 3879. | RKKVGVNNPRK; |
| 3880. | HKKVGVNNPRK; |
| 3881. | KRKVGVNNPRK; |
| 3882. | RRKVGVNNPRK; |
| 3883. | HRKVGVNNPRK; |
| 3884. | KHRVGVNNPRK; |
| 3885. | RHRVGVNNPRK; |
| 3886. | HHRVGVNNPRK; |
| 3887. | KKRVGVNNPRK; |
| 3888. | RKRVGVNNPRK; |
| 3889. | HKRVGVNNPRK; |
| 3890. | KRRVGVNNPRK; |
| 3891. | RRRVGVNNPRK; |
| 3892. | HRRVGVNNPRK; |
| 3893. | KHHLGLEEPHK; |
| 3894. | RHHLGLEEPHK; |
| 3895. | HHHLGLEEPHK; |
| 3896. | KKHLGLEEPHK; |
| 3897. | RKHLGLEEPHK; |
| 3898. | HKHLGLEEPHK; |
| 3899. | KRHLGLEEPHK; |
| 3900. | RRHLGLEEPHK; |
| 3901. | HRHLGLEEPHK; |
| 3902. | KHKLGLEEPHK; |
| 3903. | RHKLGLEEPHK; |
| 3904. | HHKLGLEEPHK; |
| 3905. | KKKLGLEEPHK; |
| 3906. | RKKLGLEEPHK; |
| 3907. | HKKLGLEEPHK; |
| 3908. | KRKLGLEEPHK; |
| 3909. | RRKLGLEEPHK; |
| 3910. | HRKLGLEEPHK; |
| 3911. | KHRLGLEEPHK; |
| 3912. | RHRLGLEEPHK; |
| 3913. | HHRLGLEEPHK; |
| 3914. | KKRLGLEEPHK; |
| 3915. | RKRLGLEEPHK; |
| 3916. | HKRLGLEEPHK; |
| 3917. | KRRLGLEEPHK; |
| 3918. | RRRLGLEEPHK; |
| 3919. | HRRLGLEEPHK; |
| 3920. | KHHIGLEEPHK; |
| 3921. | RHHIGLEEPHK; |
| 3922. | HHHIGLEEPHK; |
| 3923. | KKHIGLEEPHK; |
| 3924. | RKHIGLEEPHK; |
| 3925. | HKHIGLEEPHK; |
| 3926. | KRHIGLEEPHK; |
| 3927. | RRHIGLEEPHK; |
| 3928. | HRHIGLEEPHK; |
| 3929. | KHKIGLEEPHK; |
| 3930. | RHKIGLEEPHK; |
| 3931. | HHKIGLEEPHK; |
| 3932. | KKKIGLEEPHK; |
| 3933. | RKKIGLEEPHK; |
| 3934. | HKKIGLEEPHK; |
| 3935. | KRKIGLEEPHK; |
| 3936. | RRKIGLEEPHK; |
| 3937. | HRKIGLEEPHK; |
| 3938. | KHRIGLEEPHK; |
| 3939. | RHRIGLEEPHK; |
| 3940. | HHRIGLEEPHK; |
| 3941. | KKRIGLEEPHK; |
| 3942. | RKRIGLEEPHK; |
| 3943. | HKRIGLEEPHK; |
| 3944. | KRRIGLEEPHK; |
| 3945. | RRRIGLEEPHK; |
| 3946. | HRRIGLEEPHK; |
| 3947. | KHHVGLEEPHK; |
| 3948. | RHHVGLEEPHK; |
| 3949. | HHHVGLEEPHK; |

TABLE 7-continued

SEQ ID NO. shown to left of sequence(cont'd)

| | |
|---|---|
| 3950. | KKHVGLEEPHK; |
| 3951. | RKHVGLEEPHK; |
| 3952. | HKHVGLEEPHK; |
| 3953. | KRHVGLEEPHK; |
| 3954. | RRHVGLEEPHK; |
| 3955. | HRHVGLEEPHK; |
| 3956. | KHKVGLEEPHK; |
| 3957. | RHKVGLEEPHK; |
| 3958. | HHKVGLEEPHK; |
| 3959. | KKKVGLEEPHK; |
| 3960. | RKKVGLEEPHK; |
| 3961. | HKKVGLEEPHK; |
| 3962. | KRKVGLEEPHK; |
| 3963. | RRKVGLEEPHK; |
| 3964. | HRKVGLEEPHK; |
| 3965. | KHRVGLEEPHK; |
| 3966. | RHRVGLEEPHK;. |
| 3967. | HHRVGLEEPHK; |
| 3968. | KKRVGLEEPHK; |
| 3969. | RKRVGLEEPHK; |
| 3970. | HKRVGLEEPHK; |
| 3971. | KRRVGLEEPHK; |
| 3972. | RRRVGLEEPHK; |
| 3973. | HRRVGLEEPHK; |
| 3974. | KHHLGIEEPHK; |
| 3975. | RHHLGIEEPHK; |
| 3976. | HHHLGIEEPHK; |
| 3977. | KKHLGIEEPHK; |
| 3978. | RKHLGIEEPHK; |
| 3979. | HKHLGIEEPHK; |
| 3980. | KRHLGIEEPHK; |
| 3981. | RRHLGIEEPHK; |
| 3982. | HRHLGIEEPHK; |
| 3983. | KHKLGIEEPHK; |
| 3984. | RHKLGIEEPHK; |
| 3985. | HHKLGIEEPHK; |
| 3986. | KKKLGIEEPHK; |
| 3987. | RKKLGIEEPHK; |
| 3988. | HKKLGIEEPHK; |
| 3989. | KRKLGIEEPHK; |
| 3990. | RRKLGIEEPHK; |
| 3991. | HRKLGIEEPHK; |
| 3992. | KHRLGIEEPHK; |
| 3993. | RHRLGIEEPHK; |
| 3994. | HHRLGIEEPHK; |
| 3995. | KKRLGIEEPHK; |
| 3996. | RKRLGIEEPHK; |
| 3997. | HKRLGIEEPHK; |
| 3998. | KRRLGIEEPHK; |
| 3999. | RRRLGIEEPHK; |
| 4000. | HRRLGIEEPHK; |
| 4001. | KHHIGIEEPHK; |
| 4002. | RHHIGIEEPHK; |
| 4003. | HHHIGIEEPHK; |
| 4004. | KKHIGIEEPHK; |
| 4005. | RKHIGIEEPHK; |
| 4006. | HKHIGIEEPHK; |
| 4007. | KRHIGIEEPHK; |
| 4008. | RRHIGIEEPHK; |
| 4009. | HRHIGIEEPHK; |
| 4010. | KHKIGIEEPHK; |
| 4011. | RHKIGIEEPHK; |
| 4012. | HHKIGIEEPHK; |
| 4013. | KKKIGIEEPHK; |
| 4014. | RKKIGIEEPHK; |
| 4015. | HKKIGIEEPHK; |
| 4016. | KRKIGIEEPHK; |
| 4017. | RRKIGIEEPHK; |
| 4018. | HRKIGIEEPHK; |
| 4019. | KHRIGIEEPHK; |
| 4020. | RHRIGIEEPHK; |
| 4021. | HHRIGIEEPHK; |
| 4022. | KKRIGIEEPHK; |
| 4023. | RKRIGIEEPHK; |
| 4024. | HKRIGIEEPHK; |
| 4025. | KRRIGIEEPHK; |
| 4026. | RRRIGIEEPHK; |
| 4027. | HRRIGIEEPHK; |

TABLE 7-continued

| SEQ ID NO. shown to left of sequence(cont'd) | |
|---|---|
| 4028. | KHHVGIEEPHK; |
| 4029. | RHHVGIEEPHK; |
| 4030. | HHHVGIEEPHK; |
| 4031. | KKHVGIEEPHK; |
| 4032. | RKHVGIEEPHK; |
| 4033. | HKHVGIEEPHK; |
| 4034. | KRHVGIEEPHK; |
| 4035. | RRHVGIEEPHK; |
| 4036. | HRHVGIEEPHK; |
| 4037. | KHKVGIEEPHK; |
| 4038. | RHKVGIEEPHK; |
| 4039. | HHKVGIEEPHK; |
| 4040. | KKKVGIEEPHK; |
| 4041. | RKKVGIEEPHK; |
| 4042. | HKKVGIEEPHK; |
| 4043. | KRKVGIEEPHK; |
| 4044. | RRKVGIEEPHK; |
| 4045. | HRKVGIEEPHK; |
| 4046. | KHRVGIEEPHK; |
| 4047. | RHRVGIEEPHK; |
| 4048. | HHRVGIEEPHK; |
| 4049. | KKRVGIEEPHK; |
| 4050. | RKRVGIEEPHK; |
| 4051. | HKRVGIEEPHK; |
| 4052. | KRRVGIEEPHK; |
| 4053. | RRRVGIEEPHK; |
| 4054. | HRRVGIEEPHK; |
| 4055. | KHHLGVEEPHK; |
| 4056. | RHHLGVEEPHK; |
| 4057. | HHHLGVEEPHK; |
| 4058. | KKHLGVEEPHK; |
| 4059. | RKHLGVEEPHK; |
| 4060. | HKHLGVEEPHK; |
| 4061. | KRHLGVEEPHK; |
| 4062. | RRHLGVEEPHK; |
| 4063. | HRHLGVEEPHK; |
| 4064. | KHKLGVEEPHK; |
| 4065. | RHKLGVEEPHK; |
| 4066. | HHKLGVEEPHK; |
| 4067. | KKKLGVEEPHK; |
| 4068. | RKKLGVEEPHK; |
| 4069. | HKKLGVEEPHK; |
| 4070. | KRKLGVEEPHK; |
| 4071. | RRKLGVEEPHK; |
| 4072. | HRKLGVEEPHK; |
| 4073. | KHRLGVEEPHK; |
| 4074. | RHRLGVEEPHK; |
| 4075. | HHRLGVEEPHK; |
| 4076. | KKRLGVEEPHK; |
| 4077. | RKRLGVEEPHK; |
| 4078. | HKRLGVEEPHK; |
| 4079. | KRRLGVEEPHK; |
| 4080. | RRRLGVEEPHK; |
| 4081. | HRRLGVEEPHK; |
| 4082. | KHHIGVEEPHK; |
| 4083. | RHHIGVEEPHK; |
| 4084. | HHHIGVEEPHK; |
| 4085. | KKHIGVEEPHK; |
| 4086. | RKHIGVEEPHK; |
| 4087. | HKHIGVEEPHK; |
| 4088. | KRHIGVEEPHK; |
| 4089. | RRHIGVEEPHK; |
| 4090. | HRHIGVEEPHK; |
| 4091. | KHKIGVEEPHK; |
| 4092. | RHKIGVEEPHK; |
| 4093. | HHKIGVEEPHK; |
| 4094. | KKKIGVEEPHK; |
| 4095. | RKKIGVEEPHK; |
| 4096. | HKKIGVEEPHK; |
| 4097. | KRKIGVEEPHK; |
| 4098. | RRKIGVEEPHK; |
| 4099. | HRKIGVEEPHK; |
| 4100. | KHRIGVEEPHK; |
| 4101. | RHRIGVEEPHK; |
| 4102. | HHRIGVEEPHK; |
| 4101. | KKRIGVEEPHK; |
| 4104. | RKRIGVEEPHK; |
| 4105. | HKRIGVEEPHK; |

TABLE 7-continued

SEQ ID NO. shown to left of sequence(cont'd)

| | |
|---|---|
| 4106. | KRRIGVEEPHK; |
| 4107. | RRRIGVEEPHK; |
| 4108. | HRRIGVEEPHK; |
| 4109. | KHHVGVEEPHK; |
| 4110. | RHHVGVEEPHK; |
| 4111. | HHHVGVEEPHK; |
| 4112. | KKHVGVEEPHK; |
| 4113. | RKHVGVEEPHK; |
| 4114. | HKHVGVEEPHK; |
| 4115. | KRHVGVEEPHK; |
| 4116. | RRHVGVEEPHK; |
| 4117. | HRHVGVEEPHK; |
| 4118. | KHKVGVEEPHK; |
| 4119. | RHKVGVEEPHK; |
| 4120. | HHKVGVEEPHK; |
| 4121. | KKKVGVEEPHK; |
| 4122. | RKKVGVEEPHK; |
| 4123. | HKKVGVEEPHK; |
| 4124. | KRKVGVEEPHK; |
| 4125. | RRKVGVEEPHK; |
| 4126. | HRKVGVEEPHK; |
| 4127. | KHRVGVEEPHK; |
| 4128. | RHRVGVEEPHK; |
| 4129. | HHRVGVEEPHK; |
| 4130. | KKRVGVEEPHK; |
| 4131. | RKRVGVEEPHK; |
| 4132. | HKRVGVEEPHK; |
| 4133. | KRRVGVEEPHK; |
| 4134. | RRRVGVEEPHK; |
| 4135. | HRRVGVEEPHK; |
| 4136. | KHHLGLNEPHK; |
| 4137. | RHHLGLNEPHK; |
| 4138. | HHHLGLNEPHK; |
| 4139. | KKHLGLNEPHK; |
| 4140. | RKHLGLNEPHK; |
| 4141. | HKHLGLNEPHK; |
| 4142. | KRHLGLNEPHK; |
| 4143. | RRHLGLNEPHK; |
| 4144. | HRHLGLNEPHK; |

TABLE 7-continued

SEQ ID NO. shown to left of sequence(cont'd)

| | |
|---|---|
| 4145. | KHKLGLNEPHK; |
| 4146. | RHKLGLNEPHK; |
| 4147. | HHKLGLNEPHK; |
| 4148. | KKKLGLNEPHK; |
| 4149. | RKKLGLNEPHK; |
| 4150. | HKKLGLNEPHK; |
| 4151. | KRKLGLNEPHK; |
| 4152. | RRKLGLNEPHK; |
| 4153. | HRKLGLNEPHK; |
| 4154. | KHRLGLNEPHK; |
| 4155. | RHRLGLNEPHK; |
| 4156. | HHRLGLNEPHK; |
| 4157. | KKRLGLNEPHK; |
| 4158. | RKRLGLNEPHK; |
| 4159. | HKRLGLNEPHK; |
| 4160. | KRRLGLNEPHK; |
| 4161. | RRRLGLNEPHK; |
| 4162. | HRRLGLNEPHK; |
| 4163. | KHHIGLNPHK; |
| 4164. | RHHIGLNEPHK; |
| 4165. | HHHIGLNEPHK; |
| 4166. | KKHIGLNEPHK; |
| 4167. | RKHIGLNEPHK; |
| 4168. | HHHIGLNEPHK; |
| 4169. | KRHIGLNEPHK; |
| 4170. | RRHIGLNEPHK; |
| 4171. | HRHIGLNEPHK; |
| 4172. | KHKIGLNEPHK; |
| 4173. | RHKIGLNEPHK; |
| 4174. | HHKIGLNEPHK; |
| 4175. | KKKIGLNEPHK; |
| 4176. | RKKIGLNEPHK; |
| 4177. | HKKIGLNEPHK; |
| 4178. | KRKIGLNEPHK; |
| 4179. | RRKIGLNEPHK; |
| 4180. | HRKIGLNEPHK; |
| 4181. | KHRIGLNEPHK; |
| 4182. | RHRIGLNEPHK; |
| 4183. | HHRIGLNEPHK; |

TABLE 7-continued

SEQ ID NO. shown to left of sequence(cont'd)

| SEQ ID NO. | Sequence |
|---|---|
| 4184. | KKRIGLNEPHK; |
| 4185. | RKRIGLNEPHK; |
| 4186. | HKRIGLNEPHK; |
| 4187. | KRRIGLNEPHK; |
| 4188. | RRRIGLNEPHK; |
| 4189. | HRRIGLNEPHK; |
| 4190. | KHHVGLNEPHK; |
| 4191. | RHHVGLNEPHK; |
| 4192. | HHHVGLNEPHK; |
| 4193. | KKHVGLNEPHK; |
| 4194. | RKHVGLNEPHK; |
| 4195. | HKHVGLNEPHK; |
| 4196. | KRHVGLNEPHK; |
| 4197. | RRHVGLNEPHK; |
| 4198. | HRHVGLNEPHK; |
| 4199. | KHKVGLNEPHK; |
| 4200. | RHKVGLNEPHK; |
| 4201. | HHKVGLNEPHK; |
| 4202. | KKKVGLNEPHK; |
| 4203. | RKKVGLNEPHK; |
| 4204. | HKKVGLNEPHK; |
| 4205. | KRKVGLNEPHK; |
| 4206. | RRKVGLNEPHK; |
| 4207. | HRKVGLNEPHK; |
| 4208. | KHRVGLNEPHK; |
| 4209. | RHRVGLNEPHK; |
| 4210. | HHRVGLNEPHK; |
| 4211. | KKRVGLNEPHK; |
| 4212. | RKRVGLNEPHK; |
| 4213. | HKRVGLNEPHK; |
| 4214. | KRRVGLNEPHK; |
| 4215. | RRRVGLNEPHK; |
| 4216. | HRRVGLNEPHK; |
| 4217. | KHHLGINEPHK; |
| 4218. | RHHLGINEPHK; |
| 4219. | HHHLGINEPHK; |
| 4220. | KKHLGINEPHK; |
| 4221. | RKHLGINEPHK; |
| 4222. | HKHLGINEPHK; |
| 4223. | KRHLGINEPHK; |
| 4224. | RRHLGINEPHK; |
| 4225. | HRHLGINEPHK; |
| 4226. | KHKLGINEPHK; |
| 4227. | RHKLGINEPHK; |
| 4228. | HHKLGINEPHK; |
| 4229. | KKKLGINEPHK; |
| 4230. | RKKLGINEPHK; |
| 4231. | HKKLGINEPHK; |
| 4232. | KRKLGLNEPHK; |
| 4233. | RRKLGINEPHK; |
| 4234. | HRKLGLNEPHK; |
| 4235. | KHRLGINEPHK; |
| 4236. | RHRLGINEPHK; |
| 4237. | HHRLGINEPHK; |
| 4238. | KKRLGINEPHK; |
| 4239. | RKRLGINEPHK; |
| 4240. | HKRLGINEPHK; |
| 4241. | KRRLGINEPHK; |
| 4242. | RRRLGINEPHK; |
| 4243. | HRRLGINEPHK; |
| 4244. | KHHIGIENPHK; |
| 4245. | RHHIGINEPHK; |
| 4246. | HHHIGINEPHK; |
| 4247. | KKHIGINEPHK; |
| 4248. | RKHIGINEPHK; |
| 4249. | HKHIGINEPHK; |
| 4250. | KRHIGINEPHK; |
| 4251. | RRHIGINEPHK; |
| 4252. | HRHIGINEPHK; |
| 4253. | KHKIGINEPHK; |
| 4254. | RHKIGINEPHK; |
| 4255. | HHKIGINEPHK; |
| 4256. | KKKIGINEPHK; |
| 4257. | RKKIGINEPHK; |
| 4258. | HKKIGINEPHK; |
| 4259. | KRKIGLNEPHK; |
| 4260. | RRKIGINEPHK; |
| 4261. | HRKIGINEPHK; |

TABLE 7-continued

SEQ ID NO. shown to left of sequence(cont'd)

| | |
|---|---|
| 4262. | KHRIGINEPHK; |
| 4263. | RHRIGINEPHK; |
| 4264. | HHRIGINEPHK; |
| 4265. | KKRIGINEPHK; |
| 4266. | RKRIGINEPHK; |
| 4267. | HKRIGINEPHK; |
| 4268. | KRRIGINEPHK; |
| 4269. | RRRIGINEPHK; |
| 4270. | HRRIGINEPHK; |
| 4271. | KHHVGINEPHK; |
| 4272. | RHHVGINEPHK; |
| 4273. | HHHVGINEPHK; |
| 4274. | KKHVGINEPHK; |
| 4275. | RKHVGINEPHK; |
| 4276. | HKHVGINEPHK; |
| 4277. | KRHVGINEPHK; |
| 4278. | RRHVGINEPHK; |
| 4279. | HRHVGINEPHK; |
| 4280. | KHKVGINEPHK; |
| 4281. | RHKVGINEPHK; |
| 4282. | HHKVGINEPHK; |
| 4283. | KKHVGINEPHK; |
| 4284. | RKKVGINEPHK; |
| 4285. | HKKVGINEPHK; |
| 4286. | KRKVGINEPHK; |
| 4287. | RRKVGINEPHK; |
| 4288. | HRKVGINEPHK; |
| 4289. | KHRVGINEPHK; |
| 4290. | RHRVGINEPHK; |
| 4291. | HHRVGINEPHK; |
| 4292. | KKRVGINEPHK; |
| 4293. | RKRVGINEPHK; |
| 4294. | HKRVGINEPHK; |
| 4295. | KRRVGINEPHK; |
| 4296. | RRRVGINEPHK; |
| 4297. | HRRVGINEPHK; |
| 4298. | KHHLGVNEPHK; |
| 4299. | RHHLGVNEPHK; |
| 4300. | HHHLGVNEPHK; |
| 4301. | KKHLGVNEPHK; |
| 4302. | RKHLGVNEPHK; |
| 4303. | HKHLGVNEPHK; |
| 4304. | KRHLGVNEPHK; |
| 4305. | RRHLGVNEPHK; |
| 4306. | HRHLGVNEPHK; |
| 4307. | KHKLGVNEPHK; |
| 4308. | RHKLGVNEPHK; |
| 4309. | HHKLGVNEPHK; |
| 4310. | KKKLGVNEPHK; |
| 4311. | RKKLGVNEPHK; |
| 4312. | HKKLGVNEPHK; |
| 4313. | KRKLGVNEPHK; |
| 4314. | RRKLGVNEPHK; |
| 4315. | HRKLGVNEPHK; |
| 4316. | KHRLGVNEPHK; |
| 4317. | RHRLGVNEPHK; |
| 4318. | HHRLGVNEPHK; |
| 4319. | KKRLGVNEPHK; |
| 4320. | RKRLGVNEPHK; |
| 4321. | HKRLGVNEPHK; |
| 4322. | KRRLGVNEPHK; |
| 4323. | RRRLGVNEPHK; |
| 4324. | HRRLGVNEPHK; |
| 4325. | KHHIGVNEPHK; |
| 4326. | RHHIGVNEPHK; |
| 4327. | HHHIGVNEPHK; |
| 4328. | KKHIGVNEPHK; |
| 4329. | RKHIGVNEPHK; |
| 4330. | HKHIGVNEPHK; |
| 4331. | KRHIGVNEPHK; |
| 4332. | RRHIGVNEPHK; |
| 4333. | HRHIGVNEPHK; |
| 4334. | KHKIGVNEPHK; |
| 4335. | RHKIGVNEPHK; |
| 4336. | HHKIGVNEPHK; |
| 4337. | KKKIGVNEPHK; |
| 4338. | RKKIGVNEPHK; |
| 4339. | HKKIGVNEPHK; |

TABLE 7-continued

SEQ ID NO. shown to left of sequence(cont'd)

| | |
|---|---|
| 4340. | KRKIGVNEPHK; |
| 4341. | RRKIGVNEPHK; |
| 4342. | HRKIGVNEPHK; |
| 4343. | KHRIGVNEPHK; |
| 4344. | RHRIGVNEPHK; |
| 4345. | HHRIGVNEPHK; |
| 4346. | KKRIGVNEPHK; |
| 4347. | RKRIGVNEPHK; |
| 4348. | HKRIGVNEPHK; |
| 4349. | KRRIGVNEPHK; |
| 4350. | RRRIGVNEPHK; |
| 4351. | HRRIGVNEPHK; |
| 4352. | KHHVGVNEPHK; |
| 4353. | RHHVGVNEPHK; |
| 4354. | HHHVGVNEPHK; |
| 4355. | KKHVGVNEPHK; |
| 4356. | RKHVGVNEPHK; |
| 4357. | HKHVGVNEPHK; |
| 4358. | KRHVGVNEPHK; |
| 4359. | RRHVGVNEPHK; |
| 4360. | HRHVGVNEPHK; |
| 4361. | KHKVGVNEPHK; |
| 4362. | RHKVGVNEPHK; |
| 4363. | HHKVGVNEPHK; |
| 4364. | KKKVGVNEPHK; |
| 4365. | RKKVGVNEPHK; |
| 4366. | HKKVGVNEPHK; |
| 4367. | KRKVGVNEPHK; |
| 4368. | RRKVGVNEPHK; |
| 4369. | HRKVGVNEPHK; |
| 4370. | KHRVGVNEPHK; |
| 4371. | RHRVGVNEPHK; |
| 4372. | HHRVGVNEPHK; |
| 4373. | KKRVGVNEPHK; |
| 4374. | RKRVGVNEPHK; |
| 4375. | HKRVGVNEPHK; |
| 4376. | KRRVGVNEPHK; |
| 4377. | RRRVGVNEPHK; |
| 4378. | HRRVGVNEPHK; |

TABLE 7-continued

SEQ ID NO. shown to left of sequence(cont'd)

| | |
|---|---|
| 4379. | KHHLGLENPHK; |
| 4380. | RHHLGLENPHK; |
| 4381. | HHHLGLENPHK; |
| 4382. | KKHLGLENPHK; |
| 4383. | RKHLGLENPHK; |
| 4384. | HKHLGLENPHK; |
| 4385. | KRHLGLENPHK; |
| 4386. | RRHLGLENPHK; |
| 4387. | HRHLGLENPHK; |
| 4388. | KHKLGLENPHK; |
| 4389. | RHKLGLENPHK; |
| 4390. | HHKLGLENPHK; |
| 4391. | KKKLGLENPHK; |
| 4392. | RKKLGLENPHK; |
| 4393. | HKKLGLENPHK; |
| 4394. | KRKLGLENPHK; |
| 4395. | RRKLGLENPHK; |
| 4396. | HRKLGLENPHK; |
| 4397. | KHRLGLENPHK; |
| 4398. | RHRLGLENPHK; |
| 4399. | HHRLGLENPHK; |
| 4400. | KKRLGLENPHK; |
| 4401. | RKRLGLENPHK; |
| 4402. | HKRLGLENPHK; |
| 4403. | KRRLGLENPHK; |
| 4404. | RRRLGLENPHK; |
| 4405. | HRRLGLENPHK; |
| 4406. | KHHIGLENPHK; |
| 4407. | RHHIGLENPHK; |
| 4408. | HHHIGLENPHK; |
| 4409. | KKHIGLENPHK; |
| 4410. | RKHIGLENPHK; |
| 4411. | HKHIGLENPHK; |
| 4412. | KRHIGLENPHK; |
| 4413. | RRHIGLENPHK; |
| 4414. | HRHIGLENPHK; |
| 4415. | KHKIGLENPHK; |
| 4416. | RHKIGLENPHK; |
| 4417. | HHKIGLENPHK; |

TABLE 7-continued

SEQ ID NO. shown to left of sequence(cont'd)

| | |
|---|---|
| 4418. | KKKIGLENPHK; |
| 4419. | RKKIGLENPHK; |
| 4420. | HKKIGLENPHK; |
| 4421. | KRKIGLENPHK; |
| 4422. | RRKIGLENPHK; |
| 4423. | HRKIGLENPHK; |
| 4424. | KHRIGLENPHK; |
| 4425. | RHRIGLENPHK; |
| 4426. | HHRIGLENPHK; |
| 4427. | KKRIGLENPHK; |
| 4428. | RKRIGLENPHK; |
| 4429. | HKRIGLENPHK; |
| 4430. | KRRIGLENPHK; |
| 4431. | RRRIGLENPHK; |
| 4432. | HRRIGLENPHK; |
| 4433. | KHHVGLENPHK; |
| 4434. | RHHVGLENPHK; |
| 4435. | HHHVGLENPHK; |
| 4436. | KKHVGLENPHK; |
| 4437. | RKHVGLENPHK; |
| 4438. | HKHVGLENPHK; |
| 4439. | KRHVGLENPHK; |
| 4440. | RRHVGLENPHK; |
| 4441. | HRHVGLENPHK; |
| 4442. | KHKVGLENPHK; |
| 4443. | RHKVGLENPHK; |
| 4444. | HHKVGLENPHK; |
| 4445. | KKKVGLENPHK; |
| 4446. | RKKVGLENPHK; |
| 4447. | HKKVGLENPHK; |
| 4448. | KRKVGLENPHK; |
| 4449. | RRKVGLENPHK; |
| 4450. | HRKVGLENPHK; |
| 4451. | KHRVGLENPHK; |
| 4452. | RHRVGLENPHK; |
| 4453. | HHRVGLENPHK; |
| 4454. | KKRVGLENPHK; |
| 4455. | RKRVGLENPHK; |
| 4456. | HKRVGLENPHK; |

TABLE 7-continued

SEQ ID NO. shown to left of sequence(cont'd)

| | |
|---|---|
| 4457. | KRRVGLENPHK; |
| 4458. | RRRVGLENPHK; |
| 4459. | HRRVGLENPHK; |
| 4460. | KHHLGIENPHK; |
| 4461. | RHHLGIENPHK; |
| 4462. | HHHLGIENPHK; |
| 4463. | KKHLGIENPHK; |
| 4464. | RKHLGIENPHK; |
| 4465. | HKHLGIENPHK; |
| 4466. | KRHLGIENPHK; |
| 4467. | RRHLGIENPHK; |
| 4468. | HRHLGIENPHK; |
| 4469. | KHKLGIENPHK; |
| 4470. | RHKLGIENPHK; |
| 4471. | HHKLGIENPHK; |
| 4472. | KKKLGIENPHK; |
| 4473. | RKKLGIENPHK; |
| 4474. | HKKLGIENPHK; |
| 4475. | KRKLGIENPHK; |
| 4476. | RRKLGIENPHK; |
| 4477. | HRKLGIENPHK; |
| 4478. | KHRLGIENPHK; |
| 4479. | RHRLGIENPHK; |
| 4480. | HHRLGIENPHK; |
| 4481. | KKRLGIENPHK; |
| 4482. | RKRLGIENPHK; |
| 4483. | HKRLGIENPHK; |
| 4484. | KRRLGIENPHK; |
| 4485. | RRRLGIENPHK; |
| 4486. | HRRLGIENPHK; |
| 4487. | KHHIGIENPHK; |
| 4488. | RHHIGIENPHK; |
| 4489. | HHHIGIENPHK; |
| 4490. | KKHIGIENPHK; |
| 4491. | RKHIGIENPHK; |
| 4492. | HKHIGIENPHK; |
| 4493. | KRHIGIENPHK; |
| 4494. | RRHIGIENPHK; |
| 4495. | HRHIGIENPHK; |

TABLE 7-continued

SEQ ID NO. shown to left of sequence(cont'd)

| | |
|---|---|
| 4496. | KHKIGIENPHK; |
| 4497. | RHKIGIENPHK; |
| 4498. | HHKIGIENPHK; |
| 4499. | KKKIGIENPHK; |
| 4500. | RKKIGIENPHK; |
| 4501. | HKKIGIENPHK; |
| 4502. | KRKIGIENPHK; |
| 4503. | RRKIGIENPHK; |
| 4504. | HRKIGIENPHK; |
| 4505. | KHRIGIENPHK; |
| 4506. | RHRIGIENPHK; |
| 4507. | HHRIGIENPHK; |
| 4508. | KKRIGIENPHK; |
| 4509. | RKRIGIENPHK; |
| 4510. | HKRIGIENPHK; |
| 4511. | KRRIGIENPHK; |
| 4512. | RRRIGIENPHK; |
| 4513. | HRRIGIENPHK; |
| 4514. | KHHVGIENPHK; |
| 4515. | RHHVGIENPHK; |
| 4516. | HHHVGIENPHK; |
| 4517. | KKHVGIENPHK; |
| 4518. | RKHVGIENPHK; |
| 4519. | HKHVGIENPHK; |
| 4520. | KRHVGIENPHK; |
| 4521. | RRHVGIENPHK; |
| 4522. | HRHVGIENPHK; |
| 4523. | KHKVGIENPHK; |
| 4524. | RHKVGIENPHK; |
| 4525. | HHKVGIENPHK; |
| 4526. | KKKVGIENPHK; |
| 4527. | RKKVGIENPHK; |
| 4528. | HKKVGIENPHK; |
| 4529. | KRKVGIENPHK; |
| 4530. | RRKVGIENPHK; |
| 4531. | HRKVGIENPHK; |
| 4532. | KHRVGIENPHK; |
| 4533. | RHRVGIENPHK; |
| 4534. | HHRVGIENPHK; |
| 4535. | KKRVGIENPHK; |
| 4536. | RKRVGIENPHK; |
| 4537. | HKRVGIENPHK; |
| 4538. | KRRVGIENPHK; |
| 4539. | RRRVGIENPHK; |
| 4540. | HRRVGIENPHK; |
| 4541. | KHHLGVENPHK; |
| 4542. | RHHLGVENPHK; |
| 4543. | HHHLGVENPHK; |
| 4544. | KKHLGVENPHK; |
| 4545. | RKHLGVENPHK; |
| 4546. | HKHLGVENPHK; |
| 4547. | KRHLGVENPHK; |
| 4548. | RRHLGVENPHK; |
| 4549. | HRHLGVENPHK; |
| 4550. | KHKLGVENPHK; |
| 4551. | RHKLGVENPHK; |
| 4552. | HHKLGVENPHK; |
| 4553. | KKKLGVENPHK; |
| 4554. | RKKLGVENPHK; |
| 4555. | HKKLGVENPHK; |
| 4556. | KRKLGVENPHK; |
| 4557. | RRKLGVENPHK; |
| 4558. | HRKLGVENPHK; |
| 4559. | KHRLGVENPHK; |
| 4560. | RHRLGVENPHK; |
| 4561. | HHRLGVENPHK; |
| 4562. | KKRLGVENPHK; |
| 4563. | RKRLGVENPHK; |
| 4564. | HKRLGVENPHK; |
| 4565. | KRRLGVENPHK; |
| 4566. | RRRLGVENPHK; |
| 4567. | HRRLGVENPHK; |
| 4568. | KHHIGVENPHK; |
| 4569. | RHHIGVEEPHK; |
| 4570. | HHHIGVENPHK; |
| 4571. | KKHIGVENPHK; |
| 4572. | RKHIGVENPHK; |
| 4573. | HKHIGVENPHK; |

TABLE 7-continued

SEQ ID NO. shown to left of sequence(cont'd)

| SEQ ID NO. | Sequence |
|---|---|
| 4574. | KRHIGVENPHK; |
| 4575. | RRHIGVENPHK; |
| 4576. | HRHIGVENPHK; |
| 4577. | KHKIGVENPHK; |
| 4578. | RHKIGVENPHK; |
| 4579. | HHKVGVENPHK; |
| 4580. | KKKIGVENPHK; |
| 4581. | RKKIGVENPHK; |
| 4582. | HKKIGVENPHK; |
| 4583. | KRKIGVENPHK; |
| 4584. | RRKIGVENPHK; |
| 4585. | HRKIGVENPHK; |
| 4586. | KHRIGVENPHK; |
| 4587. | RHRIGVENPHK; |
| 4588. | HHRIGVENPHK; |
| 4589. | KKRIGVENPHK; |
| 4590. | RKRIGVENPHK; |
| 4591. | HKRIGVENPHK; |
| 4592. | KRRIGVENPHK; |
| 4593. | RRRIGVENPHK; |
| 4594. | HRRIGVENPHK; |
| 4595. | KHHVGVENPHK; |
| 4596. | RHHVGVENPHK; |
| 4597. | HHHVGVENPHK; |
| 4598. | KKHVGVENPHK; |
| 4599. | RHHVGVENPHK; |
| 4600. | HKHVGVENPHK; |
| 4601. | KRHVGVENPHK; |
| 4602. | RRHVGVENPHK; |
| 4603. | HRHVGVENPHK; |
| 4604. | KHKVGVENPHK; |
| 4605. | RHKVGVENPHK; |
| 4606. | HHKVGVENPHK; |
| 4607. | KKKVGVENPHK; |
| 4608. | RKKVGVENPHK; |
| 4609. | HKKVGVENPHK; |
| 4610. | KRKVGVENPHK; |
| 4611. | RRKVGVEEPHK; |
| 4612. | HRKVGVENPHK; |
| 4613. | KHRVGVENPHK; |
| 4614. | RHRVGVENPHK; |
| 4615. | HHRVGVENPHK; |
| 4616. | KKRVGVENPHK; |
| 4617. | RKRVGVENPHK; |
| 4618. | HKRVGVENPHK; |
| 4619. | KRRVGVENPHK; |
| 4620. | RRRVGVENPHK; |
| 4621. | HRRVGVENPHK; |
| 4622. | KHHLGLNNPHK; |
| 4623. | RHHLGLNNPHK; |
| 4624. | HHHLGLNNPHK; |
| 4625. | KKHLGLNNPHK; |
| 4626. | RKHLGLNNPHK; |
| 4627. | HKHLGLNNPHK; |
| 4628. | KRHLGLNNPHK; |
| 4629. | RRHLGLNNPHK; |
| 4630. | HRHLGLNNPHK; |
| 4631. | KHKLGLNNPHK; |
| 4632. | RHKLGLNNPHK; |
| 4633. | HHKLGLNNPHK; |
| 4634. | KKKLGLNNPHK; |
| 4635. | RKKLGLNNPHK; |
| 4636. | HKKLGLNNPHK; |
| 4637. | KRKLGLNNPHK; |
| 4638. | RRKLGLNNPHK; |
| 4639. | HRKLGLNNPHK; |
| 4640. | KHRLGLNNPHK; |
| 4641. | RHRLGLNNPHK; |
| 4642. | HHRLGLNNPHK; |
| 4643. | KKRLGLNNPHK; |
| 4644. | RKRLGLNNPHK; |
| 4645. | HKRLGLNNPHK; |
| 4646. | KRRLGLNNPHK; |
| 4647. | RRRLGLNNPHK; |
| 4648. | HRRLGLNNPHK; |
| 4649. | KHHIGLNNPHK; |
| 4650. | RHHIGLNNPHK; |
| 4651. | HHHIGLNNPHK; |

TABLE 7-continued

SEQ ID NO. shown to left of sequence (cont'd)

| SEQ ID NO. | Sequence |
|---|---|
| 4652. | KKHIGLNNPHK; |
| 4653. | RKHIGLNNPHK; |
| 4654. | HKHIGLNNPHK; |
| 4655. | KRHIGLNNPHK; |
| 4656. | RRHIGLNNPHK; |
| 4657. | HRHIGLNNPHK; |
| 4658. | KHKIGLNNPHK; |
| 4659. | RHKIGLNNPHK; |
| 4660. | HHKIGLNNPHK; |
| 4661. | KKKIGLNNPHK; |
| 4662. | RKKIGLNNPHK; |
| 4663. | HKKIGLNNPHK; |
| 4664. | KRKIGLNNPHK; |
| 4665. | RRKIGLNNPHK; |
| 4666. | HRKIGLNNPHK; |
| 4667. | KHRIGLNNPHK; |
| 4668. | RHRIGLNNPHK; |
| 4669. | HHRIGLNNPHK; |
| 4670. | KKRIGLNNPHK; |
| 4671. | RKRIGLNNPHK; |
| 4672. | HKRIGLNNPHK; |
| 4673. | KRRIGLNNPHK; |
| 4674. | RRRIGLNNPHK; |
| 4675. | HRRIGLNNPHK; |
| 4676. | KHHVGLNNPHK; |
| 4677. | RHHVGLNNPHK; |
| 4678. | HHHVGLNNPHK; |
| 4679. | KKHVGLNNPHK; |
| 4680. | RKHVGLNNPHK; |
| 4681. | HKHVGLNNPHK; |
| 4682. | KRHVGLNNPHK; |
| 4683. | RRHVGLNNPHK; |
| 4684. | HRHVGLNNPHK; |
| 4685. | KHKVGLNNPHK; |
| 4686. | RHKVGLNNPHK; |
| 4687. | HHKVGLNNPHK; |
| 4688. | KKKVGLNNPHK; |
| 4689. | RKKVGLNNPHK; |
| 4690. | HKKVGLNNPHK; |
| 4691. | KRKVGLNNPHK; |
| 4692. | RRKVGLNNPHK; |
| 4693. | HRKVGLNNPHK; |
| 4694. | KHRVGLNNPHK; |
| 4695. | RHRVGLNNPHK; |
| 4696. | HHRVGLNNPHK; |
| 4697. | KKRVGLNNPHK; |
| 4698. | RKRVGLNNPHK; |
| 4699. | HKRVGLNNPHK; |
| 4700. | KRRVGLNNPHK; |
| 4701. | RRRVGLNNPHK; |
| 4702. | HRRVGLNNPHK; |
| 4703. | KHHLGINNPHK; |
| 4704. | RHHLGINNPHK; |
| 4705. | HHHLGINNPHK; |
| 4706. | KKHLGINNPHK; |
| 4707. | RKHLGINNPHK; |
| 4708. | HKHLGINNPHK; |
| 4709. | KRHLGINNPHK; |
| 4710. | RRHLGINNPHK; |
| 4711. | HRHLGINNPHK; |
| 4712. | KHKLGINNPHK; |
| 4713. | RHKLGINNPHK; |
| 4714. | HHKLGINNPHK; |
| 4715. | KKKLGINNPHK; |
| 4716. | RHKLGINNPHK; |
| 4717. | HKKLGINNPHK; |
| 4718. | KRKLGINNPHK; |
| 4719. | RRKLGINNPHK; |
| 4720. | HRKLGINNPHK; |
| 4721. | KHRLGINNPHK; |
| 4722. | RHRLGINNPHK; |
| 4723. | HHRLGINNPHK; |
| 4724. | KKRLGINNPHK; |
| 4725. | RKRLGINNPHK; |
| 4726. | HKRLGINNPHK; |
| 4727. | KRRLGINNPHK; |
| 4728. | RRRLGINNPHK; |
| 4729. | HRRLGINNPHK; |

TABLE 7-continued

SEQ ID NO. shown to left of sequence(cont'd)

| | |
|---|---|
| 4730. | KHHIGIENPHK; |
| 4731. | RHHIGINNPHK; |
| 4732. | HHHIGINNPHK; |
| 4733. | KKHIGINNPHK; |
| 4734. | RKHIGINNPHK; |
| 4735. | HKHIGINNPHK; |
| 4736. | KRHIGINNPHK; |
| 4737. | RRHIGINNPHK; |
| 4738. | HRHIGINNPHK; |
| 4739. | KHKIGINNPHK; |
| 4740. | RHKIGVNNPHK; |
| 4741. | HHKIGINNPHK; |
| 4742. | KKKIGINNPHK; |
| 4743. | RKKIGINNPHK; |
| 4744. | HKKIGINNPHK; |
| 4745. | KRKIGINNPHK; |
| 4746. | RRKIGINNPHK; |
| 4747. | HRKIGVNNPHK; |
| 4748. | KHRIGINNPHK; |
| 4749. | RHRIGINNPHK; |
| 4750. | HHRIGINNPHK; |
| 4751. | KKRIGINNPHK; |
| 4752. | RKRIGINNPHK; |
| 4753. | HKRIGINNPHK; |
| 4754. | KRRIGINNPHK; |
| 4755. | RRRIGINNPHK; |
| 4756. | HRRIGINNPHK; |
| 4757. | KHHVGINNPHK; |
| 4758. | RHHVGINNPHK; |
| 4759. | HHHVGINNPHK; |
| 4760. | KKHVGINNPHK; |
| 4761. | RKHVGINNPHK; |
| 4762. | HKHVGINNPHK; |
| 4763. | KRHVGINNPHK; |
| 4764. | RRHVGINNPHK; |
| 4765. | HRHVGINNPHK; |
| 4766. | KHKVGINNPHK; |
| 4767. | RHKVGINNPHK; |
| 4768. | HHKVGINNPHK; |

TABLE 7-continued

SEQ ID NO. shown to left of sequence(cont'd)

| | |
|---|---|
| 4769. | KKKVGINNPHK; |
| 4770. | RKKVGINNPHK; |
| 4771. | HKKVGINNPHK; |
| 4772. | KRKVGINNPHK; |
| 4773. | RRKVGINNPHK; |
| 4774. | HRKVGINNPHK; |
| 4775. | KHRVGINNPHK; |
| 4776. | RHRVGINNPHK; |
| 4777. | HHRVGINNPHK; |
| 4778. | KHRVGINNPHK; |
| 4779. | RKRVGINNPHK; |
| 4780. | HKRVGINNPHK; |
| 4781. | KRRVGINNPHK; |
| 4782. | RRRVGINNPHK; |
| 4783. | HRRVGINNPHK; |
| 4784. | KHHLGVNNPHK; |
| 4785. | RHHLGVNNPHK; |
| 4786. | HHHLGVNNPHK; |
| 4787. | KKHLGVNNPHK; |
| 4788. | RKHLGVNNPHK; |
| 4789. | HKHLGVNNPHK; |
| 4790. | KRHLGVNNPHK; |
| 4791. | RRHLGVNNPHK; |
| 4792. | HRHLGVNNPHK; |
| 4793. | KHKLGVNNPHK; |
| 4794. | RHKLGVNNPHK; |
| 4795. | HHKLGVNNPHK; |
| 4796. | KKKLGVNNPHK; |
| 4797. | RKKLGVNNPHK; |
| 4798. | HKKLGVNNPHK; |
| 4799. | KRKLGVNNPHK; |
| 4800. | RRKLGVNNPHK; |
| 4801. | HRKLGVNNPHK; |
| 4802. | KHRLGVNNPHK; |
| 4803. | RHRLGVNNPHK; |
| 4804. | HHRLGVNNPHK; |
| 4805. | KKRLGVNNPHK; |
| 4806. | RKRLGVNNPHK; |
| 4807. | HKRLGVNNPHK; |

TABLE 7-continued

SEQ ID NO. shown to left of sequence(cont'd)

| | |
|---|---|
| 4808. | KRRLGVNNPHK; |
| 4809. | RRRLGVNNPHK; |
| 4810. | HRRLGVNNPHK; |
| 4811. | KHHIGVNNPHK; |
| 4812. | RHHIGVNNPHK; |
| 4813. | HHHIGVNNPHK; |
| 4814. | KKHIGVNNPHK; |
| 4815. | RKHIGVNNPHK; |
| 4816. | HKHIGVNNPHK; |
| 4817. | KHHIGVNNPHK; |
| 4818. | RRHIGVNNPHK; |
| 4819. | HRHIGVNNPHK; |
| 4820. | KHKIGVNNPHK; |
| 4821. | RHKIGVNNPHK; |
| 4822. | HHKIGVNNPHK; |
| 4823. | KKKIGVNNPHK; |
| 4824. | RKKIGVNNPHK; |
| 4825. | HKKIGVNNPHK; |
| 4826. | KRKIGVNNPHK; |
| 4827. | RRKIGVNNPHK; |
| 4828. | HRKIGVNNPHK; |
| 4829. | KHRIGVNNPHK; |
| 4830. | RHRIGVNNPHK; |
| 4831. | HHRIGVNNPHK; |
| 4832. | KKRIGVNNPHK; |
| 4833. | RKRIGVNNPHK; |
| 4834. | HKRIGVNNPHK; |
| 4835. | KRRIGVNNPHK; |
| 4836. | RRRIGVNNPHK; |
| 4837. | HRRIGVNNPHK; |
| 4838. | KHHVGVNNPHK; |
| 4839. | RHHVGVNNPHK; |
| 4840. | HHHVGVNNPHK; |
| 4841. | KKHVGVNNPHK; |
| 4842. | RKHVGVNNPHK; |
| 4843. | HKHVGVNNPHK; |
| 4844. | KRHVGVNNPHK; |
| 4845. | RRHVGVNNPHK; |
| 4846. | HRHVGVNNPHK; |

TABLE 7-continued

SEQ ID NO. shown to left of sequence(cont'd)

| | |
|---|---|
| 4847. | KHKVGVNNPHK; |
| 4848. | RHKVGVNNPHK; |
| 4849. | HHKVGVNNPHK; |
| 4850. | KKKVGVNNPHK; |
| 4851. | RKKVGVNNPHK; |
| 4852. | HKKVGVNNPHK; |
| 4853. | KRKVGVNNPHK; |
| 4854. | RRKVGVNNPHK; |
| 4855. | HRKVGVNNPHK; |
| 4856. | KHRVGVNNPHK; |
| 4857. | RHRVGVNNPHK; |
| 4858. | HHRVGVNNPHK; |
| 4859. | KKRVGVNNPHK; |
| 4860. | RKRVGVNNPHK; |
| 4861. | HKRVGVNNPHK; |
| 4862. | KRRVGVNNPHK; |
| 4863. | RRRVGVNNPHK; |
| 4864. | HRRVGVNNPHK; |
| 4865. | KHHLGLEEPRR; |
| 4866. | RHHLGLEEPRR; |
| 4867. | HHHLGLEEPRR; |
| 4868. | KKHLGLEEPRR; |
| 4869. | RKHLGLEEPRR; |
| 4870. | HKHLGLEEPRR; |
| 4871. | KRHLGLEEPRR; |
| 4872. | RRHLGLEEPRR; |
| 4873. | HRHLGLEEPRR; |
| 4874. | KHKLGLEEPRR; |
| 4875. | RHKLGLEEPRR; |
| 4876. | HHKLGLEEPRR; |
| 4877. | KKKLGLEEPRR; |
| 4878. | RKKLGLEEPRR; |
| 4879. | HKKLGLEEPRR; |
| 4880. | KRKLGLEEPRR; |
| 4881. | RRKLGLEEPRR; |
| 4882. | HRKLGLEEPRR; |
| 4883. | KHRLGLEEPRR; |
| 4884. | RHRLGLEEPRR; |
| 4885. | HHRLGLEEPRR; |

TABLE 7-continued

SEQ ID NO. shown to left of sequence(cont'd)

| | |
|---|---|
| 4886. | KKRLGLEEPRR; |
| 4887. | RKRLGLEEPRR; |
| 4888. | HKRLGLEEPRR; |
| 4889. | KRRLGLEEPRR; |
| 4890. | RRRLGLEEPRR; |
| 4891. | HRRLGLEEPRR; |
| 4892. | KHHIGLEEPRR; |
| 4893. | RHHIGLEEPRR; |
| 4894. | HHHIGLEEPRR; |
| 4895. | KKHIGLEEPRR; |
| 4896. | RKHIGLEEPRR; |
| 4897. | HKHIGLEEPRR; |
| 4898. | KRHIGLEEPRR; |
| 4899. | RRHIGLEEPRR; |
| 4900. | HRHIGLEEPRR; |
| 4901. | KHKIGLEEPRR; |
| 4902. | RHKIGLEEPRR; |
| 4903. | HHKIGLEEPRR; |
| 4904. | KKKLGLEEPRR; |
| 4905. | RKKIGLEEPRR; |
| 4906. | HKKLGLEEPRR; |
| 4907. | KRKIGLEEPRR; |
| 4908. | RRKIGLEEPRR; |
| 4909. | HRKIGLEEPRR; |
| 4910. | KHRIGLEEPRR; |
| 4911. | RHRIGLEEPRR; |
| 4912. | HHRIGLEEPRR; |
| 4913. | KKRIGLEEPRR; |
| 4914. | RKRIGLEEPRR; |
| 4915. | HKRIGLEEPRR; |
| 4916. | KRRIGLEEPRR; |
| 4917. | RRRIGLEEPRR; |
| 4918. | HRRIGLEEPRR; |
| 4919. | KHHVGLEEPRR; |
| 4920. | RHHVGLEEPRR; |
| 4921. | HHHVGLEEPRR; |
| 4922. | KKHVGLEEPRR; |
| 4923. | RKHVGLEEPRR; |
| 4924. | HKHVGLEEPRR; |
| 4925. | KRHVGLEEPRR; |
| 4926. | RRHVGLEEPRR; |
| 4927. | HRHVGLEEPRR; |
| 4928. | KHKVGLEEPRR; |
| 4929. | RHKVGLEEPRR; |
| 4930. | HHKVGLEEPRR; |
| 4931. | KKKVGLEEPRR; |
| 4932. | RKKVGLEEPRR; |
| 4933. | HKKVGLEEPRR; |
| 4934. | KRKVGLEEPRR; |
| 4935. | RRKVGLEEPRR; |
| 4936. | HRKVGLEEPRR; |
| 4937. | KHRVGLEEPRR; |
| 4938. | RHRVGLEEPRR; |
| 4939. | HHRVGLEEPRR; |
| 4940. | KKRVGLEEPRR; |
| 4941. | RKRVGLEEPRR; |
| 4942. | HKRVGLEEPRR; |
| 4943. | KRRVGLEEPRR; |
| 4944. | RRRVGLEEPRR; |
| 4945. | HRRVGLEEPRR; |
| 4946. | KHHLGIEEPRR; |
| 4947. | RHHLGIEEPRR; |
| 4948. | HHHLGIEEPRR; |
| 4949. | KKHLGIEEPRR; |
| 4950. | RKHLGIEEPRR; |
| 4951. | HKHLGIEEPRR; |
| 4952. | KRHLGIEEPRR; |
| 4953. | RRHLGIEEPRR; |
| 4954. | HRHLGIEEPRR; |
| 4955. | KHKLGIEEPRR; |
| 4956. | RHKLGIEEPRR; |
| 4957. | HHKLGIEEPRR; |
| 4958. | KKKLGIEEPRR; |
| 4959. | RKKLGIEEPRR; |
| 4960. | HKKLGIEEPRR; |
| 4961. | KRKLGIEEPRR; |
| 4962. | RRKLGIEEPRR; |
| 4963. | HRKLGIEEPRR; |

TABLE 7-continued

SEQ ID NO. shown to left of sequence(cont'd)

| | |
|---|---|
| 4964. | KHRLGIEEPRR; |
| 4965. | RHRLGIEEPRR; |
| 4966. | HHRLGIEEPRR; |
| 4967. | KKRLGIEEPRR; |
| 4968. | RKRLGIEEPRR; |
| 4969. | HKRLGIEEPRR; |
| 4970. | KRRLGIEEPRR; |
| 4971. | RRRLGIEEPRR; |
| 4972. | HRRLGIEEPRR; |
| 4973. | KHHIGIEEPRR; |
| 4974. | RHHIGIEEPRR; |
| 4975. | HHHIGIEEPRR; |
| 4976. | KKHIGIEEPRR; |
| 4977. | RKHIGIEEPRR; |
| 4978. | HKHIGIEEPRR; |
| 4979. | KRHIGIEEPRR; |
| 4980. | RRHIGIEEPRR; |
| 4981. | HRHIGIEEPRR; |
| 4982. | KHKIGIEEPRR; |
| 4983. | RHKIGIEEPRR; |
| 4984. | HHKIGIEEPRR; |
| 4985. | KKKIGIEEPRR; |
| 4986. | RKKIGIEEPRR; |
| 4987. | HKKIGIEEPRR; |
| 4988. | KRKIGIEEPRR; |
| 4989. | RRKIGIEEPRR; |
| 4990. | HRKIGIEEPRR; |
| 4991. | KHRIGIEEPRR; |
| 4992. | RHRIGIEEPRR; |
| 4993. | HHRIGIEEPRR; |
| 4994. | KKRIGIEEPRR; |
| 4995. | RKRIGIEEPRR; |
| 4996. | HKRIGIEEPRR; |
| 4997. | KRRIGIEEPRR; |
| 4998. | RRRIGIEEPRR; |
| 4999. | HRRIGIEEPRR; |
| 5000. | KHHVGIEEPRR; |
| 5001. | RHHVGIEEPRR; |
| 5002. | HHHVGIEEPRR; |
| 5003. | KKHVGIEEPRR; |
| 5004. | RKHVGIEEPRR; |
| 5005. | HKHVGIEEPRR; |
| 5006. | KRHVGIEEPRR; |
| 5007. | RRHVGIEEPRR; |
| 5008. | HRHVGIEEPRR; |
| 5009. | KHKVGIEEPRR; |
| 5010. | RHKVGIEEPRR; |
| 5011. | HHKVGIEEPRR; |
| 5012. | KKKVGIEEPRR; |
| 5013. | RKKVGIEEPRR; |
| 5014. | HKKVGIEEPRR; |
| 5015. | KRKVGIEEPRR; |
| 5016. | RRKVGIEEPRR; |
| 5017. | HRKVGIEEPRR; |
| 5018. | KHRVGIEEPRR; |
| 5019. | RHRVGIEEPRR; |
| 5020. | HHRVGIEEPRR; |
| 5021. | KKRVGIEEPRR; |
| 5022. | RKRVGIEEPRR; |
| 5023. | HKRVGIEEPRR; |
| 5024. | KRRVGIEEPRR; |
| 5025. | RRRVGIEEPRR; |
| 5026. | HRRVGIEEPRR; |
| 5027. | KHHLGVEEPRR; |
| 5028. | RHHLGVEEPRR; |
| 5029. | HHHLGVEEPRR; |
| 5030. | KKHLGVEEPRR; |
| 5031. | RKHLGVEEPRR; |
| 5032. | HKHLGVEEPRR; |
| 5033. | KRHLGVEEPRR; |
| 5034. | RRHLGVEEPRR; |
| 5035. | HRHLGVEEPRR; |
| 5036. | KHKLGVEEPRR; |
| 5037. | RHKLGVEEPRR; |
| 5038. | HHKLGVEEPRR; |
| 5039. | KKKLGVEEPRR; |
| 5040. | RKKLGVEEPRR; |
| 5041. | HKKLGVEEPRR; |

TABLE 7-continued

SEQ ID NO. shown to left of sequence(cont'd)

| SEQ ID NO. | Sequence |
|---|---|
| 5042. | KRKLGVEEPRR; |
| 5043. | RRKLGVEEPRR; |
| 5044. | HRKLGVEEPRR; |
| 5045. | KHRLGVEEPRR; |
| 5046. | RHRLGVEEPRR; |
| 5047. | HHRLGVEEPRR; |
| 5048. | KHRLGVEEPRR; |
| 5049. | RKRLGVEEPRR; |
| 5050. | HKRLGVEEPRR; |
| 5051. | KRRLGVEEPRR; |
| 5052. | RRRLGVEEPRR; |
| 5053. | HRRLGVEEPRR; |
| 5054. | KHHIGVEEPRR; |
| 5055. | RHHIGVEEPRR; |
| 5056. | HHHIGVEEPRR; |
| 5057. | KKHIGVEEPRR; |
| 5058. | RKHIGVEEPRR; |
| 5059. | HKHIGVEEPRR; |
| 5060. | KRHIGVEEPRR; |
| 5061. | RRHIGVEEPRR; |
| 5062. | HRHIGVEEPRR; |
| 5063. | KHKIGVEEPRR; |
| 5064. | RHKIGVEEPRR; |
| 5065. | HHKIGVEEPRR; |
| 5066. | KKKIGVEEPRR; |
| 5067. | RKKIGVEEPRR; |
| 5068. | HKKIGVEEPRR; |
| 5069. | KRKIGVEEPRR; |
| 5070. | RRKIGVEEPRR; |
| 5071. | HRKIGVEEPRR; |
| 5072. | KHRIGVEEPRR; |
| 5073. | RHRIGVEEPRR; |
| 5074. | HHRIGVEEPRR; |
| 5075. | KKRIGVEEPRR; |
| 5076. | RKRIGVEEPRR; |
| 5077. | HKRIGVEEPRR; |
| 5078. | KRRIGVEEPRR; |
| 5079. | RRRIGVEEPRR; |
| 5080. | HRRIGVEEPRR; |

TABLE 7-continued

SEQ ID NO. shown to left of sequence(cont'd)

| SEQ ID NO. | Sequence |
|---|---|
| 5081. | KHHVGVEEPRR; |
| 5082. | RHHVGVEEPRR; |
| 5083. | HHHVGVEEPRR; |
| 5084. | KKHVGVEEPRR; |
| 5085. | RKHVGVEEPRR; |
| 5086. | HKHVGVEEPRR; |
| 5087. | KRHVGVEEPRR; |
| 5088. | RRHVGVEEPRR; |
| 5089. | HRHVGVEEPRR; |
| 5090. | KHKVGVEEPRR; |
| 5091. | RHKVGVEEPRR; |
| 5092. | HHKVGVEEPRR; |
| 5093. | KKKVGVEEPRR; |
| 5094. | RKKVGVEEPRR; |
| 5095. | HKKVGVEEPRR; |
| 5096. | KRKVGVEEPRR; |
| 5097. | RRKVGVEEPRR; |
| 5098. | HRKVGVEEPRR; |
| 5099. | KHRVGVEEPRR; |
| 5100. | RHRVGVEEPRR; |
| 5101. | HHRVGVEEPRR; |
| 5102. | KKRVGVEEPRR; |
| 5103. | RKRVGVEEPRR; |
| 5104. | HKRVGVEEPRR; |
| 5105. | KRRVGVEEPRR; |
| 5106. | RRRVGVEEPRR; |
| 5107. | HRRVGVEEPRR; |
| 5108. | KHHLGLNEPRR; |
| 5109. | RHHLGLNEPRR; |
| 5110. | HHHLGLNEPRR; |
| 5111. | KKHLGLNEPRR; |
| 5112. | RKHLGLNEPRR; |
| 5113. | HKHLGLNEPRR; |
| 5114. | KRHLGLNEPRR; |
| 5115. | RRHLGLNEPRR; |
| 5116. | HRHLGLNEPRR; |
| 5117. | KHKLGLNEPRR; |
| 5118. | RHKLGLNEPRR; |
| 5119. | HHKLGLNEPRR; |

TABLE 7-continued

SEQ ID NO. shown to left of sequence(cont'd)

| | |
|---|---|
| 5120. | KKKLGLNEPRR; |
| 5121. | RKKLGLNEPRR; |
| 5122. | HKKLGLNEPRR; |
| 5123. | KRKLGLNEPRR; |
| 5124. | RRKLGLNEPRR; |
| 5125. | HRKLGLNEPRR; |
| 5126. | KHRLGLNEPRR; |
| 5127. | RHRLGLNEPRR; |
| 5128. | HHRLGLNEPRR; |
| 5129. | KKRLGLNEPRR; |
| 5130. | RKRLGLNEPRR; |
| 5131. | HKRLGLNEPRR; |
| 5132. | KRRLGLNEPRR; |
| 5133. | RRRLGLNEPRR; |
| 5134. | HRRLGLNEPRR; |
| 5135. | KHHIGLNPRR; |
| 5136. | RHHIGLNEPRR; |
| 5137. | HHHIGLNEPRR; |
| 5138. | KKHIGLNEPRR; |
| 5139. | RKHIGLNEPRR; |
| 5140. | HKHIGLNEPRR; |
| 5141. | KRHIGLNEPRR; |
| 5142. | RRHIGLNEPRR; |
| 5143. | HRHIGLNEPRR; |
| 5144. | KHKIGLNEPRR; |
| 5145. | RHKIGLNEPRR; |
| 5146. | HHKLGLNEPRR; |
| 5147. | KKKIGLNEPRR; |
| 5148. | RKKIGLNEPRR; |
| 5149. | HKKIGLNEPRR; |
| 5150. | KRKIGLNEPRR; |
| 5151. | RRKIGLNEPRR; |
| 5152. | HRKIGLNEPRR; |
| 5153. | KHRIGLNEPRR; |
| 5154. | RHRIGLNEPRR; |
| 5155. | HHRIGLNEPRR; |
| 5156. | KKRIGLNEPRR; |
| 5157. | RKRIGLNEPRR; |
| 5158. | HKRIGLNEPRR; |

TABLE 7-continued

SEQ ID NO. shown to left of sequence(cont'd)

| | |
|---|---|
| 5159. | KRRIGLNEPRR; |
| 5160. | RRRIGLNEPRR; |
| 5161. | HRRIGLNEPRR; |
| 5162. | KHHVGLNEPRR; |
| 5163. | RHHVGLNEPRR; |
| 5164. | HHHVGLNEPRR; |
| 5165. | KKHVGLNEPRR; |
| 5166. | RKHVGLNEPRR; |
| 5167. | HKHVGLNEPRR; |
| 5168. | KRHVGLNEPRR; |
| 5169. | RRHVGLNEPRR; |
| 5170. | HRHVGLNEPRR; |
| 5171. | KHKVGLNEPRR; |
| 5172. | RHKVGLNEPRR; |
| 5173. | HHKVGLNEPRR; |
| 5174. | KKKVGLNEPRR; |
| 5175. | RKKVGLNEPRR; |
| 5176. | HKKVGLNEPRR; |
| 5177. | KRKVGLNEPRR; |
| 5178. | RRKVGLNEPRR; |
| 5179. | HRKVGLNEPRR; |
| 5180. | KHRVGLNEPRR; |
| 5181. | RHRVGLNEPRR; |
| 5182. | HHRVGLNEPRR; |
| 5183. | KKRVGLNEPRR; |
| 5184. | RKRVGLNEPRR; |
| 5185. | HKRVGLNEPRR; |
| 5186. | KRRVGLNEPRR; |
| 5187. | RRRVGLNEPRR; |
| 5188. | HRRVGLNEPRR; |
| 5189. | KHHLGINEPRR; |
| 5190. | RHHLGINEPRR; |
| 5191. | HHHLGINEPRR; |
| 5192. | KKHLGINEPRR; |
| 5193. | RKHLGINEPRR; |
| 5194. | HKHLGINEPRR; |
| 5195. | KRHLGINEPRR; |
| 5196. | RRHLGINEPRR; |
| 5197. | HRHLGINEPRR; |

TABLE 7-continued

| SEQ ID NO. shown to left of sequence(cont'd) | |
|---|---|
| 5198. | KHKLGINEPRR; |
| 5199. | RHKLGINEPRR; |
| 5200. | HHKLGINEPRR; |
| 5201. | KKKLGINEPRR; |
| 5202. | RKKLGINEPRR; |
| 5203. | HKKLGINEPRR; |
| 5204. | KRKLGINEPRR; |
| 5205. | RRKLGINEPRR; |
| 5206. | HRKLGINEPRR; |
| 5207. | KHRLGINEPRR; |
| 5208. | RHRLGINEPRR; |
| 5209. | HHRLGINEPRR; |
| 5210. | KKRLGINEPRR; |
| 5211. | RKRLGINEPRR; |
| 5212. | HKRLGINEPRR; |
| 5213. | KRRLGINEPRR; |
| 5214. | RRRLGINEPRR; |
| 5215. | HRRLGINEPRR; |
| 5216. | KHHIGIENPRR; |
| 5217. | RHHIGINEPRR; |
| 5218. | HHHIGINEPRR; |
| 5219. | KKHIGINEPRR; |
| 5220. | RKHIGINEPRR; |
| 5221. | HKHIGINEPRR; |
| 5222. | KRHIGINEPRR; |
| 5223. | RRHIGINEPRR; |
| 5224. | HRHIGINEPRR; |
| 5225. | KHKIGINEPRR; |
| 5226. | RHKIGINEPRR; |
| 5227. | HHKIGINEPRR; |
| 5228. | KKKIGINEPRR; |
| 5229. | RKKIGINEPRR; |
| 5230. | HKKIGINEPRR; |
| 5231. | KRKIGINEPRR; |
| 5232. | RRKIGINEPRR; |
| 5233. | HRKIGINEPRR; |
| 5234. | KHRIGINEPRR; |
| 5235. | RHRIGINEPRR; |
| 5236. | HHRIGINEPRR; |
| 5237. | KKHIGINEPRR; |
| 5238. | RKRIGINEPRR; |
| 5239. | HKRIGINEPRR; |
| 5240. | KRRIGINEPRR; |
| 5241. | RRRIGINEPRR; |
| 5242. | HRRIGINEPRR; |
| 5243. | KHHVGINEPRR; |
| 5244. | RHHVGINEPRR; |
| 5245. | HHHVGINEPRR; |
| 5246. | KKHVGINEPRR; |
| 5247. | RKHVGINEPRR; |
| 5248. | HKHVGVNEPRR; |
| 5249. | KRHVGINEPRR; |
| 5250. | RRHVGINEPRR; |
| 5251. | HRHVGINEPRR; |
| 5252. | KHKVGVNEPRR; |
| 5253. | RHKVGINEPRR; |
| 5254. | HHKVGINEPRR; |
| 5255. | KKKVGINEPRR; |
| 5256. | RKKVGINEPRR; |
| 5257. | HKKVGINEPRR; |
| 5258. | KRKVGINEPRR; |
| 5259. | RRKVGINEPRR; |
| 5260. | HRKVGINEPRR; |
| 5261. | KHRVGINEPRR; |
| 5262. | RHRVGINEPRR; |
| 5263. | HHRVGINEPRR; |
| 5264. | KKRVGINEPRR; |
| 5265. | RKRVGINEPRR; |
| 5266. | HKRVGINEPRR; |
| 5267. | KRRVGINEPRR; |
| 5268. | RRRVGINEPRR; |
| 5269. | HRRVGINEPRR; |
| 5270. | KHHLGVNEPRR; |
| 5271. | RHHLGVNEPRR; |
| 5272. | HHHLGVNEPRR; |
| 5273. | KHHLGVNEPRR; |
| 5274. | RKHLGVNEPRR; |
| 5275. | HKHLGVNEPRR; |

TABLE 7-continued

SEQ ID NO. shown to left of sequence(cont'd)

| | |
|---|---|
| 5276. | KRHLGVNEPRR; |
| 5277. | RRHLGVNEPRR; |
| 5278. | HRHLGVNEPRR; |
| 5279. | KHKLGVNEPRR; |
| 5280. | RHKLGVNEPRR; |
| 5281. | HHKLGVNEPRR; |
| 5282. | KKKLGVNEPRR; |
| 5283. | RKKLGVNEPRR; |
| 5284. | HKKLGVNEPRR; |
| 5285. | KRKLGVNEPRR; |
| 5286. | RRKLGVNEPRR; |
| 5287. | HRKLGVNEPRR; |
| 5288. | KHRLGVNEPRR; |
| 5289. | RHRLGVNEPRR; |
| 5290. | HHRLGVNEPRR; |
| 5291. | KKRLGVNEPRR; |
| 5292. | RKRLGVNEPRR; |
| 5293. | HKRLGVNEPRR; |
| 5294. | KRRLGVNEPRR; |
| 5295. | RRRLGVNEPRR; |
| 5296. | HRRLGVNEPRR; |
| 5297. | KHHIGVNEPRR; |
| 5298. | RHHIGVNEPRR; |
| 5299. | HHHIGVNEPRR; |
| 5300. | KKHIGVNEPRR; |
| 5301. | RKHIGVNEPRR; |
| 5302. | HKHIGVNEPRR; |
| 5303. | KRHIGVNEPRR; |
| 5304. | RRHIGVNEPRR; |
| 5305. | HRHIGVNEPRR; |
| 5306. | KHKIGVNEPRR; |
| 5307. | RHKIGVNEPRR; |
| 5308. | HHKIGVNEPRR; |
| 5309. | KKKIGVNEPRR; |
| 5310. | RKKIGVNEPRR; |
| 5311. | HKKIGVNEPRR; |
| 5312. | KRKIGVNEPRR; |
| 5313. | RRKIGVNEPRR; |
| 5314. | HRKIGVNEPRR; |
| 5315. | KHRIGVNEPRR; |
| 5316. | RHRIGVNEPRR; |
| 5317. | HHRIGVNEPRR; |
| 5318. | KKRIGVNEPRR; |
| 5319. | RKRIGVNEPRR; |
| 5320. | HKRIGVNEPRR; |
| 5321. | KRRIGVNEPRR; |
| 5322. | RRRIGVNEPRR; |
| 5323. | HRRIGVNEPRR; |
| 5324. | KHHVGVNEPRR; |
| 5325. | RHHVGVNEPRR; |
| 5326. | HHHVGVNEPRR; |
| 5327. | KKHVGVNEPRR; |
| 5328. | RKHVGVNEPRR; |
| 5329. | HKHVGVNEPRR; |
| 5330. | KRHVGVNEPRR; |
| 5331. | RRHVGVNEPRR; |
| 5332. | HRHVGVNEPRR; |
| 5333. | KHKVGVNEPRR; |
| 5334. | RHKVGVNEPRR; |
| 5335. | HHKVGVNEPRR; |
| 5336. | KKKVGVNEPRR; |
| 5337. | RKKVGVNEPRR; |
| 5338. | HKKVGVNEPRR; |
| 5339. | KRKVGVNEPRR; |
| 5340. | RRKVGVNEPRR; |
| 5341. | HRKVGVNEPRR; |
| 5342. | KHRVGVNEPRR; |
| 5343. | RHRVGVNEPRR; |
| 5344. | HHRVGVNEPRR; |
| 5345. | KKRVGVNEPRR; |
| 5346. | RKRVGVNEPRR; |
| 5347. | HKRVGVNEPRR; |
| 5348. | KRRVGVNEPRR; |
| 5349. | RRRVGVNEPRR; |
| 5350. | HRRVGVNEPRR; |
| 5351. | KHHLGLENPRR; |
| 5352. | RHHLGLENPRR; |
| 5353. | HHHLGLENPRR; |

TABLE 7-continued

SEQ ID NO. shown to left of sequence(cont'd)

| SEQ ID | Sequence |
|---|---|
| 5354. | KKHLGLENPRR; |
| 5355. | RKHLGLENPRR; |
| 5356. | HKHLGLENPRR; |
| 5357. | KRHLGLENPRR; |
| 5358. | RRHLGLENPRR; |
| 5359. | HRHLGLENPRR; |
| 5360. | KHKLGLENPRR; |
| 5361. | RHKLGLENPRR; |
| 5362. | HHKLGLENPRR; |
| 5363. | KKKLGLENPRR; |
| 5364. | RKKLGLENPRR; |
| 5365. | HKKLGLENPRR; |
| 5366. | KRKLGLENPRR; |
| 5367. | RRKLGLENPRR; |
| 5368. | HRKLGLENPRR; |
| 5369. | KHRLGLENPRR; |
| 5370. | RHRLGLENPRR; |
| 5371. | HHRLGLENPRR; |
| 5372. | KKRLGLENPRR; |
| 5373. | RKRLGLENPRR; |
| 5374. | HKRLGLENPRR; |
| 5375. | KRRLGLENPRR; |
| 5376. | RRRLGLENPRR; |
| 5377. | HRRLGLENPRR; |
| 5378. | KHHIGLENPRR; |
| 5379. | RHHIGLENPRR; |
| 5380. | HHHIGLENPRR; |
| 5381. | KKHIGLENPRR; |
| 5382. | RKHIGLENPRR; |
| 5383. | HKHIGLENPRR; |
| 5384. | KRHIGLENPRR; |
| 5385. | RRHIGLENPRR; |
| 5386. | HRHIGLENPRR; |
| 5387. | KHKIGLENPRR; |
| 5388. | RHKIGLENPRR; |
| 5389. | HHKIGLENPRR; |
| 5390. | KKKIGLENPRR; |
| 5391. | RKKIGLENPRR; |
| 5392. | HKKIGLENPRR; |
| 5393. | KRKIGLENPRR; |
| 5394. | RRHIGLENPRR; |
| 5395. | HRKIGLENPRR; |
| 5396. | KKRIGLENPRR; |
| 5397. | RHRIGLENPRR; |
| 5398. | HHRIGLENPRR; |
| 5399. | KKRIGLENPRR; |
| 5400. | RKRIGLENPRR; |
| 5401. | HKRIGLENPRR; |
| 5402. | KRRIGLENPRR; |
| 5403. | RRRIGLENPRR; |
| 5404. | HRRIGLENPRR; |
| 5405. | KHHVGLENPRR; |
| 5406. | RHHVGLENPRR; |
| 5407. | HHHVGLENPRR; |
| 5408. | KKHVGLENPRR; |
| 5409. | RKHVGLENPRR; |
| 5410. | HKHVGLENPRR; |
| 5411. | KRHVGLENPRR; |
| 5412. | RRHVGLENPRR; |
| 5413. | HRHVGLENPRR; |
| 5414. | KHKVGLENPRR; |
| 5415. | RHKVGLENPRR; |
| 5416. | HHKVGLENPRR; |
| 5417. | KKKVGLENPRR; |
| 5418. | RKKVGLENPRR; |
| 5419. | HKKVGLENPRR; |
| 5420. | KRKVGLENPRR; |
| 5421. | RRKVGLENPRR; |
| 5422. | HRKVGLENPRR; |
| 5423. | KHRVGLENPRR; |
| 5424. | RHRVGLENPRR; |
| 5425. | HHRVGLENPRR; |
| 5426. | KKRVGLENPRR; |
| 5427. | RKRVGLENPRR; |
| 5428. | HKRVGLENPRR; |
| 5429. | KRRVGLENPRR; |
| 5430. | RRRVGLENPRR; |
| 5431. | HRRVGLENPRR; |

TABLE 7-continued

| SEQ ID NO. shown to left of sequence(cont'd) | |
|---|---|
| 5432. | KHHLGIENPRR; |
| 5433. | RHHLGIENPRR; |
| 5434. | HHHLGIENPRR; |
| 5435. | KKHLGIENPRR; |
| 5436. | RKHLGIENPRR; |
| 5437. | HKHLGIENPRR; |
| 5438. | KRHLGIENPRR; |
| 5439. | RRHLGIENPRR; |
| 5440. | HRHLGIENPRR; |
| 5441. | KHKLGIENPRR; |
| 5442. | RHKLGIENPRR; |
| 5443. | HHKLGIENPRR; |
| 5444. | KKKLGIENPRR; |
| 5445. | RKKLGIENPRR; |
| 5446. | HKKLGIENPRR; |
| 5447. | KRKLGIENPRR; |
| 5448. | RRKLGIENPRR; |
| 5449. | HRKLGIENPRR; |
| 5450. | KHRLGIENPRR; |
| 5451. | RHRLGIENPRR; |
| 5452. | HHRLGIENPRR; |
| 5453. | KKRLGIENPRR; |
| 5454. | RKRLGIENPRR; |
| 5455. | HKRLGIENPRR; |
| 5456. | KRRLGIENPRR; |
| 5457. | RRRLGIENPRR; |
| 5458. | HRRLGIENPRR; |
| 5459. | KHHIGIENPRR; |
| 5460. | RHHIGIENPRR; |
| 5461. | HHHIGIENPRR; |
| 5462. | KKHIGIENPRR; |
| 5463. | RKHIGIENPRR; |
| 5464. | HKHIGIENPRR; |
| 5465. | KRHIGIENPRR; |
| 5466. | RRHIGIENPRR; |
| 5467. | HRHIGIENPRR; |
| 5468. | KHKIGIENPRR; |
| 5469. | RHKIGIENPRR; |
| 5470. | HHKIGIENPRR; |

TABLE 7-continued

| SEQ ID NO. shown to left of sequence(cont'd) | |
|---|---|
| 5471. | KKKIGIENPRR; |
| 5472. | RKKIGIENPRR; |
| 5473. | HKKIGIENPRR; |
| 5474. | KRKIGIENPRR; |
| 5475. | RRKIGIENPRR; |
| 5476. | HRKIGIENPRR; |
| 5477. | KHRIGIENPRR; |
| 5478. | RHRIGIENPRR; |
| 5479. | HHRIGIENPRR; |
| 5480. | KKRIGIENPRR; |
| 5481. | RKRIGIENPRR; |
| 5482. | HKRIGIENPRR; |
| 5483. | KRRIGIENPRR; |
| 5484. | RRRIGIENPRR; |
| 5485. | HRRIGIENPRR; |
| 5486. | KHHVGIENPRR; |
| 5487. | RHHVGIENPRR; |
| 5488. | HHKVGIENPRR; |
| 5489. | KRHVGIENPRR; |
| 5490. | RKHVGIENPRR; |
| 5491. | HKHVGIENPRR; |
| 5492. | KRHVGIENPRR; |
| 5493. | RRHVGIENPRR; |
| 5494. | HRHVGIENPRR; |
| 5495. | KHKVGIENPRR; |
| 5496. | RHKVGIENPRR; |
| 5497. | HHKVGIENPRR; |
| 5498. | KKKVGIENPRR; |
| 5499. | RKKVGIENPRR; |
| 5500. | HKKVGIENPRR; |
| 5501. | KRKVGIENPRR; |
| 5502. | RRKVGIENPRR; |
| 5503. | HRKVGIENPRR; |
| 5504. | KHRVGIENPRR; |
| 5505. | RHRVGIENPRR; |
| 5506. | HHRVGIENPRR; |
| 5507. | KKRVGIENPRR; |
| 5508. | RKRVGIENPRR; |
| 5509. | HKRVGIENPRR; |

TABLE 7-continued

SEQ ID NO. shown to left of sequence (cont'd)

| SEQ ID NO. | Sequence |
|---|---|
| 5510. | KRRVGIENPRR; |
| 5511. | RRRVGIENPRR; |
| 5512. | HRRVGIENPRR; |
| 5513. | KHHLGVENPRR; |
| 5514. | RHHLGVENPRR; |
| 5515. | HHHLGVENPRR; |
| 5516. | KKHLGVENPRR; |
| 5517. | RKHLGVENPRR; |
| 5518. | HKHLGVENPRR; |
| 5519. | KRHLGVENPRR; |
| 5520. | RRHLGVENPRR; |
| 5521. | HRHLGVENPRR; |
| 5522. | KHKLGVENPRR; |
| 5523. | RHKLGVENPRR; |
| 5524. | HHKLGVENPRR; |
| 5525. | KKKLGVENPRR; |
| 5526. | RKKLGVENPRR; |
| 5527. | HKKLGVENPRR; |
| 5528. | KRKLGVENPRR; |
| 5529. | RRKLGVENPRR; |
| 5530. | HRKLGVENPRR; |
| 5531. | KHRLGVENPRR; |
| 5532. | RHRLGVENPRR; |
| 5533. | HHRLGVENPRR; |
| 5534. | KKRLGVENPRR; |
| 5535. | RKRLGVENPRR; |
| 5536. | HKRLGVENPRR; |
| 5537. | KRRLGVENPRR; |
| 5538. | RRRLGVENPRR; |
| 5539. | HRRLGVENPRR; |
| 5540. | KHHIGVENPRR; |
| 5541. | RHHIGVEEPRR; |
| 5542. | HHHIGVENPRR; |
| 5543. | KKHIGVENPRR; |
| 5544. | RKHIGVENPRR; |
| 5545. | HKHIGVENPRR; |
| 5546. | KRHIGVENPRR; |
| 5547. | RRHIGVENPRR; |
| 5548. | HRHIGVENPRR; |
| 5549. | KHKIGVENPRR; |
| 5550. | RHKIGVENPRR; |
| 5551. | HHKIGVENPRR; |
| 5552. | KKKIGVENPRR; |
| 5553. | RKKIGVENPRR; |
| 5554. | HKKIGVENPRR; |
| 5555. | KRKIGVENPRR; |
| 5556. | RRKIGVENPRR; |
| 5557. | HRKIGVENPRR; |
| 5558. | KHRIGVENPRR; |
| 5559. | RHRIGVENPRR; |
| 5560. | HHRIGVENPRR; |
| 5561. | KKRIGVENPRR; |
| 5562. | RKRIGVENPRR; |
| 5563. | HKRIGVENPRR; |
| 5564. | KRRIGVENPRR; |
| 5565. | RRRIGVENPRR; |
| 5566. | HRRIGVENPRR; |
| 5567. | KHHVGVENPRR; |
| 5568. | RHHVGVENPRR; |
| 5569. | HHHVGVENPRR; |
| 5570. | KKHVGVENPRR; |
| 5571. | RKHVGVENPRR; |
| 5572. | HKHVGVENPRR; |
| 5573. | KRHVGVENPRR; |
| 5574. | RRHVGVENPRR; |
| 5575. | HRHVGVENPRR; |
| 5576. | KHKVGVENPRR; |
| 5577. | RHKVGVENPRR; |
| 5578. | HHKVGVENPRR; |
| 5579. | KKKVGVENPRR; |
| 5580. | RKKVGVENPRR; |
| 5581. | HKKVGVENPRR; |
| 5582. | KRKVGVENPRR; |
| 5583. | RRKVGVEEPRR; |
| 5584. | HRKVGVENPRR; |
| 5585. | KHRVGVENPRR; |
| 5586. | RHRVGVENPRR; |
| 5587. | HHRVGVENPRR; |

TABLE 7-continued

| SEQ ID NO. shown to left of sequence(cont'd) | |
|---|---|
| 5588. | KKRVGVENPRR; |
| 5589. | RKRVGVENPRR; |
| 5590. | HKRVGVENPRR; |
| 5591. | KRRVGVENPRR; |
| 5592. | RRRVGVENPRR; |
| 5593. | HRRVGVENPRR; |
| 5594. | KHHLGLNNPRR; |
| 5595. | RHHLGLNNPRR; |
| 5596. | HHHLGLNNPRR; |
| 5597. | KKHLGLNNPRR; |
| 5598. | RKHLGLNNPRR; |
| 5599. | HKHLGLNNPRR; |
| 5600. | KRHLGLNNPRR; |
| 5601. | RRHLGLNNPRR; |
| 5602. | HRHLGLNNPRR; |
| 5603. | KHKLGLNNPRR; |
| 5604. | RHKLGLNNPRR; |
| 5605. | HHKLGLNNPRR; |
| 5606. | KKKLGLNNPRR; |
| 5607. | RKKLGLNNPRR; |
| 5608. | HKKLGLNNPRR; |
| 5609. | KRKLGLNNPRR; |
| 5610. | RRKLGLNNPRR; |
| 5611. | HRKLGLNNPRR; |
| 5612. | KHRLGLNNPRR; |
| 5613. | RHRLGLNNPRR; |
| 5614. | HHRLGLNNPRR; |
| 5615. | KKRLGLNNPRR; |
| 5616. | RKRLGLNNPRR; |
| 5617. | HKRLGLNNPRR; |
| 5618. | KRRLGLNNPRR; |
| 5619. | RRRLGLNNPRR; |
| 5620. | HRRLGLNNPRR; |
| 5621. | KHHIGLNNPRR; |
| 5622. | RHHIGLNNPRR; |
| 5623. | HHHIGLNNPRR; |
| 5624. | KKHIGLNNPRR; |
| 5625. | RKHIGLNNPRR; |
| 5626. | HKHIGLNNPRR; |
| 5627. | KRHIGLNNPRR; |
| 5628. | RRHIGLNNPRR; |
| 5629. | HRHIGLNNPRR; |
| 5630. | KHKIGLNNPRR; |
| 5631. | RHKIGLNNPRR; |
| 5632. | HHKIGLNNPRR; |
| 5633. | KKKIGLNNPRR; |
| 5634. | RKKIGLNNPRR; |
| 5635. | HKKIGLNNPRR; |
| 5636. | KRKIGLNNPRR; |
| 5637. | RRKIGLNNPRR; |
| 5638. | HRKIGLNNPRR; |
| 5639. | KHRIGLNNPRR; |
| 5640. | RHRIGLNNPRR; |
| 5641. | HHRIGLNNPRR; |
| 5642. | KKRIGLNNPRR; |
| 5643. | RKRIGLNNPRR; |
| 5644. | HKRIGLNNPRR; |
| 5645. | KRRIGLNNPRR; |
| 5646. | RRRIGLNNPRR; |
| 5647. | HRRIGLNNPRR; |
| 5648. | KHHVGLNNPRR; |
| 5649. | RHHVGLNNPRR; |
| 5650. | HHHVGLNNPRR; |
| 5651. | KKHVGLNNPRR; |
| 5652. | RKHVGLNNPRR; |
| 5653. | HKHVGLNNPRR; |
| 5654. | KRHVGLNNPRR; |
| 5655. | RRHVGLNNPRR; |
| 5656. | HRHVGLNNPRR; |
| 5657. | KHKVGLNNPRR; |
| 5658. | RHKVGLNNPRR; |
| 5659. | HHKVGLNNPRR; |
| 5660. | KKKVGLNNPRR; |
| 5661. | RKKVGLNNPRR; |
| 5662. | HKKVGLNNPRR; |
| 5663. | KRKVGLNNPRR; |
| 5664. | RRKVGLNNPRR; |
| 5665. | HRKVGLNNPRR; |

TABLE 7-continued

| SEQ ID NO. shown to left of sequence(cont'd) | |
|---|---|
| 5666. | KHRVGLNNPRR; |
| 5667. | RHRVGLNNPRR; |
| 5668. | HHRVGLNNPRR; |
| 5669. | KKRVGLNNPRR; |
| 5670. | RKRVGLNNPRR; |
| 5671. | HKRVGLNNPRR; |
| 5672. | KRRVGLNNPRR; |
| 5673. | RRRVGLNNPRR; |
| 5674. | HRRVGLNNPRR; |
| 5675. | KHHLGINNPRR; |
| 5676. | RHHLGINNPRR; |
| 5677. | HHHLGINNPRR; |
| 5678. | KKHLGINNPRR; |
| 5679. | RKHLGINNPRR; |
| 5680. | HKHLGINNPRR; |
| 5681. | KRHLGINNPRR; |
| 5682. | RRHLGINNPRR; |
| 5683. | HRHLGINNPRR; |
| 5684. | KHKLGINNPRR; |
| 5685. | RHKLGINNPRR; |
| 5686. | HHKLGINNPRR; |
| 5687. | KKKLGINNPRR; |
| 5688. | RKKLGLNNPRR; |
| 5689. | HKKLGINNPRR; |
| 5690. | KRKLGINNPRR; |
| 5691. | RRKLGINNPRR; |
| 5692. | HRKLGINNPRR; |
| 5693. | KHRLGVNNPRR; |
| 5694. | RHRLGINNPRR; |
| 5695. | HHRLGINNPRR; |
| 5696. | KKRLGINNPRR; |
| 5697. | RKRLGINNPRR; |
| 5698. | HKRLGINNPRR; |
| 5699. | KRRLGINNPRR; |
| 5700. | RRRLGINNPRR; |
| 5701. | HRRLGINNPRR; |
| 5702. | KHHIGIENPRR; |
| 5703. | RHHIGINNPRR; |
| 5704. | HHHIGINNPRR; |
| 5705. | KKHIGINNPRR; |
| 5706. | RKHIGINNPRR; |
| 5707. | HKHIGINNPRR; |
| 5708. | KRHIGINNPRR; |
| 5709. | RRHIGINNPRR; |
| 5710. | HRHIGINNPRR; |
| 5711. | KHKIGINNPRR; |
| 5712. | RHKIGINNPRR; |
| 5713. | HHKIGINNPRR; |
| 5714. | KKKIGINNPRR; |
| 5715. | RKKIGINNPRR; |
| 5716. | HKKIGINNPRR; |
| 5717. | KRKIGINNPRR; |
| 5718. | RRKIGINNPRR; |
| 5719. | HRKIGINNPRR; |
| 5720. | KHRIGINNPRR; |
| 5721. | RHRIGINNPRR; |
| 5722. | HHRIGINNPRR; |
| 5723. | KKRIGINNPRR; |
| 5724. | RKRIGINNPRR; |
| 5725. | HKRIGINNPRR; |
| 5726. | KRRIGINNPRR; |
| 5727. | RRRIGINNPRR; |
| 5728. | HRRIGINNPRR; |
| 5729. | KHHVGINNPRR; |
| 5730. | RHHVGINNPRR; |
| 5731. | HHHVGINNPRR; |
| 5732. | KKHVGINNPRR; |
| 5733. | RKHVGINNPRR; |
| 5734. | HKHVGINNPRR; |
| 5735. | KRHVGINNPRR; |
| 5736. | RRHVGINNPRR; |
| 5737. | HRHVGINNPRR; |
| 5738. | KHKVGINNPRR; |
| 5739. | RHHVGINNPRR; |
| 5740. | HHKVGINNPRR; |
| 5741. | KKKVGLNNPRR; |
| 5742. | RKKVGINNPRR; |
| 5743. | HKKVGINNPRR; |

TABLE 7-continued

SEQ ID NO. shown to left of sequence(cont'd)

| SEQ ID NO. | Sequence |
|---|---|
| 5744. | KRKVGINNPRR; |
| 5745. | RRKVGINNPRR; |
| 5746. | HRKVGINNPRR; |
| 5747. | KHRVGINNPRR; |
| 5748. | RHRVGINNPRR; |
| 5749. | HHRVGINNPRR; |
| 5750. | KKRVGINNPRR; |
| 5751. | RKRVGINNPRR; |
| 5752. | HKRVGINNPRR; |
| 5753. | KRRVGINNPRR; |
| 5754. | RRRVGINNPRR; |
| 5755. | HRRVGINNPRR; |
| 5756. | KHHLGVNNPRR; |
| 5757. | RHHLGVNNPRR; |
| 5758. | HHHLGVNNPRR; |
| 5759. | KKHLGVNNPRR; |
| 5760. | RKHLGVNNPRR; |
| 5761. | HKHLGVNNPRR; |
| 5762. | KRHLGVNNPRR; |
| 5763. | RRHLGVNNPRR; |
| 5764. | HRHLGVNNPRR; |
| 5765. | KHKLGVNNPRR; |
| 5766. | RHKLGVNNPRR; |
| 5767. | HHKLGVNNPRR; |
| 5768. | KKKLGVNNPRR; |
| 5769. | RKKLGVNNPRR; |
| 5770. | HKKLGVNNPRR; |
| 5771. | KRKLGVNNPRR; |
| 5772. | RRKLGVNNPRR; |
| 5773. | HRKLGVNNPRR; |
| 5774. | KHRLGVNNPRR; |
| 5775. | RHRLGVNNPRR; |
| 5776. | HHRLGVNNPRR; |
| 5777. | KKRLGVNNPRR; |
| 5778. | RKRLGVNNPRR; |
| 5779. | HKRLGVNNPRR; |
| 5780. | KRRLGVNNPRR; |
| 5781. | RRRLGVNNPRR; |
| 5782. | HRRLGVNNPRR; |

TABLE 7-continued

SEQ ID NO. shown to left of sequence(cont'd)

| SEQ ID NO. | Sequence |
|---|---|
| 5783. | KHHIGVNNPRR; |
| 5784. | RHHIGVNNPRR; |
| 5785. | HHHIGVNNPRR; |
| 5786. | KKHIGVNNPRR; |
| 5787. | RKHIGVNNPRR; |
| 5788. | HKHIGVNNPRR; |
| 5789. | KRHIGVNNPRR; |
| 5790. | RRHIGVNNPRR; |
| 5791. | HRHIGVNNPRR; |
| 5792. | KHKIGVNNPRR; |
| 5793. | RHKIGVNNPRR; |
| 5794. | HHKIGVNNPRR; |
| 5795. | KKKIGVNNPRR; |
| 5796. | RKHIGVNNPRR; |
| 5797. | HKKIGVNNPRR; |
| 5798. | KRKIGVNNPRR; |
| 5799. | RRKIGVNNPRR; |
| 5800. | HRKIGVNNPRR; |
| 5801. | KHRIGVNNPRR; |
| 5802. | RHRIGVNNPRR; |
| 5803. | HHRIGVNNPRR; |
| 5804. | KKRIGVNNPRR; |
| 5805. | RKRIGVNNPRR; |
| 5806. | HKRIGVNNPRR; |
| 5807. | KRRIGVNNPRR; |
| 5808. | RRRIGVNNPRR; |
| 5809. | HRRLGVNNPRR; |
| 5810. | KHHVGVNNPRR; |
| 5811. | RHHVGVNNPRR; |
| 5812. | HHHVGVNNPRR; |
| 5813. | KKHVGVNNPRR; |
| 5814. | RKHVGVNNPRR; |
| 5815. | HKHVGVNNPRR; |
| 5816. | KRHVGVNNPRR; |
| 5817. | RRHVGVNNPRR; |
| 5818. | HRHVGVNNPRR; |
| 5819. | KHKVGVNNPRR; |
| 5820. | RHKVGVNNPRR; |
| 5821. | HHKVGVNNPRR; |

TABLE 7-continued

SEQ ID NO. shown to left of sequence(cont'd)

| | |
|---|---|
| 5822. | KKKVGVNNPRR; |
| 5823. | RKKVGVNNPRR; |
| 5824. | HKKVGVNNPRR; |
| 5825. | KRKVGVNNPRR; |
| 5826. | RRKVGVNNPRR; |
| 5827. | HRKVGVNNPRR; |
| 5828. | KHRVGVNNPRR; |
| 5829. | RHRVGVNNPRR; |
| 5830. | HHRVGVNNPRR; |
| 5831. | KKRVGVNNPRR; |
| 5832. | RKRVGVNNPRR; |
| 5833. | HKRVGVNNPRR; |
| 5834. | KRRVGVNNPRR; |
| 5835. | RRRVGVNNPRR; |
| 5836. | HRRVGVNNPRR; |
| 5837. | KHHLGLEEPRH; |
| 5838. | RHHLGLEEPRH; |
| 5839. | HHHLGLEEPRH; |
| 5840. | KKHLGLEEPRH; |
| 5841. | RKHLGLEEPRH; |
| 5842. | HKHLGLEEPRH; |
| 5843. | KRHLGLEEPRH; |
| 5844. | RRHLGLEEPRH; |
| 5845. | HRHLGLEEPRH; |
| 5846. | KHKLGLEEPRH; |
| 5847. | RHKLGLEEPRH; |
| 5848. | HHKLGLEEPRH; |
| 5849. | KKKLGLEEPRH; |
| 5850. | RKKLGLEEPRH; |
| 5851. | HKKLGLEEPRH; |
| 5852. | KRKLGLEEPRH; |
| 5853. | RRKLGLEEPRH; |
| 5854. | HRKLGLEEPRH; |
| 5855. | KHRLGLEEPRH; |
| 5856. | RHRLGLEEPRH; |
| 5857. | HHRLGLEEPRH; |
| 5858. | KKRLGLEEPRH; |
| 5859. | RKRLGLEEPRH; |
| 5860. | HKRLGLEEPRH; |

TABLE 7-continued

SEQ ID NO. shown to left of sequence(cont'd)

| | |
|---|---|
| 5861. | KRRLGLEEPRH; |
| 5862. | RRRLGLEEPRH; |
| 5863. | HRRLGLEEPRH; |
| 5864. | KHHIGLEEPRH; |
| 5865. | RHHIGLEEPRH; |
| 5866. | HHHIGLEEPRH; |
| 5867. | KKHIGLEEPRH; |
| 5868. | RKHIGLEEPRH; |
| 5869. | HKHIGLEEPRH; |
| 5870. | KRHIGLEEPRH; |
| 5871. | RRHIGLEEPRH; |
| 5872. | HRHIGLEEPRH; |
| 5873. | KHKIGLEEPRH; |
| 5874. | RHKIGLEEPRH; |
| 5875. | HHKIGLEEPRH; |
| 5876. | KKKIGLEEPRH; |
| 5877. | RKKIGLEEPRH; |
| 5878. | HKKIGLEEPRH; |
| 5879. | KRKIGLEEPRH; |
| 5880. | RRKIGLEEPRH; |
| 5881. | HRKIGLEEPRH; |
| 5882. | KHRIGLEEPRH; |
| 5583. | RHRIGLEEPRH; |
| 5884. | HHRIGLEEPRH; |
| 5885. | KKRIGLEEPRH; |
| 5886. | RKRIGLEEPRH; |
| 5887. | HKRIGLEEPRH; |
| 5888. | KRRIGLEEPRH; |
| 5889. | RRRIGLEEPRH; |
| 5890. | HRRIGLEEPRH; |
| 5891. | KHHVGLEEPRH; |
| 5892. | RHHVGLEEPRH; |
| 5893. | HHHVGLEEPRH; |
| 5894. | KKHVGLEEPRH; |
| 5895. | RKHVGLEEPRH; |
| 5896. | HKHVGLEEPRH; |
| 5897. | KRHVGLEEPRH; |
| 5898. | RRHVGLEEPRH; |
| 5899. | HRHVGLEEPRH; |

TABLE 7-continued

SEQ ID NO. shown to left of sequence(cont'd)

| SEQ ID NO. | Sequence |
|---|---|
| 5900. | KHKVGLEEPRH; |
| 5901. | RHKVGLEEPRH; |
| 5902. | HHKVGLEEPRH; |
| 5903. | KKKVGLEEPRH; |
| 5904. | RKKVGLEEPRH; |
| 5905. | HKKVGLEEPRH; |
| 5906. | KRKVGLEEPRH; |
| 5907. | RRKVGLEEPRH; |
| 5908. | HRKVGLEEPRH; |
| 5909. | KHRVGLEEPRH; |
| 5910. | RHRVGLEEPRH; |
| 5911. | HHRVGLEEPRH; |
| 5912. | KKRVGLEEPRH; |
| 5913. | RKRVGLEEPRH; |
| 5914. | HKRVGLEEPRH; |
| 5915. | KRRVGLEEPRH; |
| 5916. | RRRVGLEEPRH; |
| 5917. | HRRVGLEEPRH; |
| 5918. | KHHLGIEEPRH; |
| 5919. | RHHLGIEEPRH; |
| 5920. | HHHLGIEEPRH; |
| 5921. | KKHLGIEEPRH; |
| 5922. | RKHLGIEEPRH; |
| 5923. | HKHLGIEEPRH; |
| 5924. | KRHLGIEEPRH; |
| 5925. | RRHLGIEEPRH; |
| 5926. | HRHLGIEEPRH; |
| 5927. | KHKLGIEEPRH; |
| 5928. | RHKLGIEEPRH; |
| 5929. | HHKLGIEEPRH; |
| 5930. | KKKLGIEEPRH; |
| 5931. | RKKLGIEEPRH; |
| 5932. | HKKLGIEEPRH; |
| 5933. | KRKLGIEEPRH; |
| 5934. | RRKLGIEEPRH; |
| 5935. | HRKLGIEEPRH; |
| 5936. | KHRLGIEEPRH; |
| 5937. | RHRLGIEEPRH; |
| 5938. | HHRLGIEEPRH; |
| 5939. | KKRLGIEEPRH; |
| 5940. | RKRLGIEEPRH; |
| 5941. | HKRLGIEEPRH; |
| 5942. | KRRLGIEEPRH; |
| 5943. | RRRLGIEEPRH; |
| 5944. | HRRLGIEEPRH; |
| 5945. | KHHIGIEEPRH; |
| 5946. | RHHIGIEEPRH; |
| 5947. | HHHIGIEEPRH; |
| 5948. | KKHIGIEEPRH; |
| 5949. | RKHIGIEEPRH; |
| 5950. | HKHIGIEEPRH; |
| 5951. | KRHIGIEEPRH; |
| 5952. | RRHIGIEEPRH; |
| 5953. | HRHIGIEEPRH; |
| 5954. | KHKIGIEEPRH; |
| 5955. | RHKIGIEEPRH; |
| 5956. | HHKIGIEEPRH; |
| 5957. | KKKIGIEEPRH; |
| 5958. | RKKIGIEEPRH; |
| 5959. | HKKIGIEEPRH; |
| 5960. | KRKIGIEEPRH; |
| 5961. | RRKIGIEEPRH; |
| 5962. | HRKIGIEEPRH; |
| 5963. | KHRIGIEEPRH; |
| 5964. | RHRIGIEEPRH; |
| 5965. | HHRIGIEEPRH; |
| 5966. | KKRIGIEEPRH; |
| 5967. | RKRIGIEEPRH; |
| 5968. | HKRIGIEEPRH; |
| 5969. | KRRIGIEEPRH; |
| 5970. | RRRIGIEEPRH; |
| 5971. | HRRIGIEEPRH; |
| 5972. | KHHVGIEEPRH; |
| 5973. | RHHVGIEEPRH; |
| 5974. | HHHVGIEEPRH; |
| 5975. | KKHVGIEEPRH; |
| 5976. | RKHVGIEEPRH; |
| 5977. | HKHVGIEEPRH; |

TABLE 7-continued

| SEQ ID NO. shown to left of sequence(cont'd) | |
|---|---|
| 5978. | KRHVGIEEPRH; |
| 5979. | RRHVGIEEPRH; |
| 5980. | HRHVGIEEPRH; |
| 5981. | KHKVGIEEPRH; |
| 5982. | RHKVGIEEPRH; |
| 5983. | HHKVGIEEPRH; |
| 5984. | KKKVGIEEPRH; |
| 5985. | RKKVGIEEPRH; |
| 5986. | HKKVGIEEPRH; |
| 5987. | KRKVGIEEPRH; |
| 5988. | RRKVGIEEPRH; |
| 5989. | HRKVGIEEPRH; |
| 5990. | KHRVGIEEPRH; |
| 5991. | RHRVGIEEPRH; |
| 5992. | HHRVGIEEPRH; |
| 5993. | KKRVGIEEPRH; |
| 5994. | RKRVGIEEPRH; |
| 5995. | HKRVGIEEPRH; |
| 5996. | KRRVGIEEPRH; |
| 5997. | RRRVGIEEPRH; |
| 5998. | HRRVGIEEPRH; |
| 5999. | KHHLGVEEPRH; |
| 6000. | RHHLGVEEPRH; |
| 6001. | HHHLGVEEPRH; |
| 6002. | KKHLGVEEPRH; |
| 6003. | RKHLGVEEPRH; |
| 6004. | HKHLGVEEPRH; |
| 6005. | KRHLGVEEPRH; |
| 6006. | RRHLGVEEPRH; |
| 6007. | HRHLGVEEPRH; |
| 6008. | KHKLGVEEPRH; |
| 6009. | RHKLGVEEPRH; |
| 6010. | HHKLGVEEPRH; |
| 6011. | KKKLGVEEPRH; |
| 6012. | RKKLGVEEPRH; |
| 6013. | HKKLGVEEPRH; |
| 6014. | KRKLGVEEPRH; |
| 6015. | RRKLGVEEPRH; |
| 6016. | HRKLGVEEPRH; |
| 6017. | KHRLGVEEPRH; |
| 6018. | RHRLGVEEPRH; |
| 6019. | HHRLGVEEPRH; |
| 6020. | KKRLGVEEPRH; |
| 6021. | RKRLGVEEPRH; |
| 6022. | HKRLGVEEPRH; |
| 6023. | KRRLGVEEPRH; |
| 6024. | RRRLGVEEPRH; |
| 6025. | HRRLGVEEPRH; |
| 6026. | KHHIGVEEPRH; |
| 6027. | RHHIGVEEPRH; |
| 6028. | HHHIGVEEPRH; |
| 6029. | KKHIGVEEPRH; |
| 6030. | RKHIGVEEPRH; |
| 6031. | HKHIGVEEPRH; |
| 6032. | KRHIGVEEPRH; |
| 6033. | RRHIGVEEPRH; |
| 6034. | HRHIGVEEPRH; |
| 6035. | KHKIGVEEPRH; |
| 6036. | RHKIGVEEPRH; |
| 6037. | HHKIGVEEPRH; |
| 6038. | KKKIGVEEPRH; |
| 6039. | RKKIGVEEPRH; |
| 6040. | HKKIGVEEPRH; |
| 6041. | KRKIGVEEPRH; |
| 6042. | RRKIGVEEPRH; |
| 6043. | HRKIGVEEPRH; |
| 6044. | KHRIGVEEPRH; |
| 6045. | RHRIGVEEPRH; |
| 6046. | HHRIGVEEPRH; |
| 6047. | KKRIGVEEPRH; |
| 6048. | RKRIGVEEPRH; |
| 6049. | HKRIGVEEPRH; |
| 6050. | KRRIGVEEPRH; |
| 6051. | RRRIGVEEPRH; |
| 6052. | HRRIGVEEPRH; |
| 6053. | KHHVGVEEPRH; |
| 6054. | RHHVGVEEPRH; |
| 6055. | HHHVGVEEPRH; |

TABLE 7-continued

SEQ ID NO. shown to left of sequence(cont'd)

| | |
|---|---|
| 6056. | KKHVGVEEPRH; |
| 6057. | RKHVGVEEPRH; |
| 6058. | HKHVGVEEPRH; |
| 6059. | KRHVGVEEPRH; |
| 6060. | RRHVGVEEPRH; |
| 6061. | HRHVGVEEPRH; |
| 6062. | KHKVGVEEPRH; |
| 6063. | RHKVGVEEPRH; |
| 6064. | HHKVGVEEPRH; |
| 6065. | KKKVGVEEPRH; |
| 6066. | RKKVGVEEPRH; |
| 6067. | HKKVGVEEPRH; |
| 6068. | KRKVGVEEPRH; |
| 6069. | RRKVGVEEPRH; |
| 6070. | HRKVGVEEPRH; |
| 6071. | KHRVGVEEPRH; |
| 6072. | RHRVGVEEPRH; |
| 6073. | HHRVGVEEPRH; |
| 6074. | KKRVGVEEPRH; |
| 6075. | RKRVGVEEPRH; |
| 6076. | HKRVGVEEPRH; |
| 6077. | KRRVGVEEPRH; |
| 6078. | RRRVGVEEPRH; |
| 6079. | HRRVGVEEPRH; |
| 6080. | KHHLGLNEPRH; |
| 6081. | RHHLGLNEPRH; |
| 6082. | HHHLGLNEPRH; |
| 6083. | KKHLGLNEPRH; |
| 6084. | RKHLGLNEPRH; |
| 6085. | HKHLGLNEPRH; |
| 6086. | KRHLGLNEPRH; |
| 6087. | RRHLGLNEPRH; |
| 6088. | HRHLGLNEPRH; |
| 6089. | KHKLGLNEPRH; |
| 6090. | RHKLGLNEPRH; |
| 6091. | HHKLGLNEPRH; |
| 6092. | KKKLGLNEPRH; |
| 6093. | RKKLGLNEPRH; |
| 6094. | HKKLGLNEPRH; |
| 6095. | KRKLGLNEPRH; |
| 6096. | RRKLGLNEPRH; |
| 6097. | HRKLGLNEPRH; |
| 6098. | KHRLGLNEPRH; |
| 6099. | RHRLGLNEPRH; |
| 6100. | HHRLGLNEPRH; |
| 6101. | KKRLGLNEPRH; |
| 6102. | RKRLGLNEPRH; |
| 6103. | HKRLGLNEPRH; |
| 6104. | KRRLGLNEPRH; |
| 6105. | RRRLGLNEPRH; |
| 6106. | HRRLGLNEPRH; |
| 6107. | KHHIGLNPRH; |
| 6108. | RHHIGLNEPRH; |
| 6109. | HHHIGLNEPRH; |
| 6110. | KKHIGLNEPRH; |
| 6111. | RKHIGLNEPRH; |
| 6112. | HKHIGLNEPRH; |
| 6113. | KRHIGLNEPRH; |
| 6114. | RRHIGLNEPRH; |
| 6115. | HRHIGLNEPRH; |
| 6116. | KHKIGLNEPRH; |
| 6117. | RHKIGLNEPRH; |
| 6118. | HHKIGLNEPRH; |
| 6119. | KKKIGLNEPRH; |
| 6120. | RKKIGLNEPRH; |
| 6121. | HKKIGLNEPRH; |
| 6122. | KRKIGLNEPRH; |
| 6123. | RRKIGLNEPRH; |
| 6124. | HRKIGLNEPRH; |
| 6125. | KHRIGLNEPRH; |
| 6126. | RHRIGLNEPRH; |
| 6127. | HHRIGLNEPRH; |
| 6128. | KKRIGLNEPRH; |
| 6129. | RKRIGLNEPRH; |
| 6130. | HKRIGLNEPRH; |
| 6131. | KRRIGLNEPRH; |
| 6132. | RRRIGLNEPRH; |
| 6133. | HRRIGLNEPRH; |

TABLE 7-continued

SEQ ID NO. shown to left of sequence(cont'd)

| | |
|---|---|
| 6134. | KHHVGLNEPRH; |
| 6135. | RHHVGLNEPRH; |
| 6136. | HHHVGLNEPRH; |
| 6137. | KKHVGLNEPRH; |
| 6138. | RKHVGLNEPRH; |
| 6139. | HKHVGLNEPRH; |
| 6140. | KRHVGLNEPRH; |
| 6141. | RRHVGLNEPRH; |
| 6142. | HRHVGLNEPRH; |
| 6143. | KHKVGLNEPRH; |
| 6144. | RHKVGLNEPRH; |
| 6145. | HHKVGLNEPRH; |
| 6146. | KKKVGLNEPRH; |
| 6147. | RKKVGLNEPRH; |
| 6148. | HKKVGLNEPRH; |
| 6149. | KRKVGLNEPRH; |
| 6150. | RRKVGLNEPRH; |
| 6151. | HRKVGLNEPRH; |
| 6152. | KHRVGLNEPRH; |
| 6153. | RHRVGLNEPRH; |
| 6154. | HHRVGLNEPRH; |
| 6155. | KKRVGLNEPRH; |
| 6156. | RKRVGLNEPRH; |
| 6157. | HKRVGLNEPRH; |
| 6158. | KRRVGLNEPRH; |
| 6159. | RRRVGLNEPRH; |
| 6160. | HRRVGLNEPRH; |
| 6161. | KHHLGINEPRH; |
| 6162. | RHHLGINEPRH; |
| 6163. | HHHLGINEPRH; |
| 6164. | KKHLGINEPRH; |
| 6165. | RKHLGINEPRH; |
| 6166. | HKHLGINEPRH; |
| 6167. | KRHLGINEPRH; |
| 6168. | RRHLGINEPRH; |
| 6169. | HRHLGINEPRH; |
| 6170. | KHKLGINEPRH; |
| 6171. | RHKLGINEPRH; |
| 6172. | HHKLGINEPRH; |

TABLE 7-continued

SEQ ID NO. shown to left of sequence(cont'd)

| | |
|---|---|
| 6173. | KKKLGINEPRH; |
| 6174. | RKKLGINEPRH; |
| 6175. | HKKLGINEPRH; |
| 6176. | KRKLGINEPRH; |
| 6177. | RRKLGINEPRH; |
| 6178. | HRKLGINEPRH; |
| 6179. | KHRLGINEPRH; |
| 6180. | RHRLGINEPRH; |
| 6181. | HHRLGINEPRH; |
| 6182. | KKRLGINEPRH; |
| 6183. | RKRLGINEPRH; |
| 6184. | HKRLGINEPRH; |
| 6185. | KRRLGINEPRH; |
| 6186. | RRRLGINEPRH; |
| 6187. | HRRLGINEPRH; |
| 6188. | KHHIGIENPRH; |
| 6189. | RHHIGINEPRH; |
| 6190. | HHHIGINEPRH; |
| 6191. | KKHIGINEPRH; |
| 6192. | RKHIGINEPRH; |
| 6193. | HKHIGINEPRH; |
| 6194. | KRHIGINEPRH; |
| 6195. | RRHIGINEPRH; |
| 6196. | HRHIGINEPRH; |
| 6197. | KHKIGINEPRH; |
| 6198. | RHKIGINEPRH; |
| 6199. | HHKIGINEPRH; |
| 6200. | KKKIGINEPRH; |
| 6201. | RKKIGINEPRH; |
| 6202. | HKKIGINEPRH; |
| 6203. | KRKIGINEPRH; |
| 6204. | RRKIGINEPRH; |
| 6205. | HRKIGINEPRH; |
| 6206. | KHRIGINEPRH; |
| 6207. | RHRIGINEPRH; |
| 6208. | HHRIGINEPRH; |
| 6209. | KKRIGINEPRH; |
| 6210. | RKRIGINEPRH; |
| 6211. | HKRIGINEPRH; |

TABLE 7-continued

SEQ ID NO. shown to left of sequence(cont'd)

| SEQ ID NO. | Sequence |
|---|---|
| 6212. | KRRIGINEPRH; |
| 6213. | RRRIGINEPRH; |
| 6214. | HRRIGINEPRH; |
| 6215. | KHHVGINEPRH; |
| 6216. | RHHVGINEPRH; |
| 6217. | HHHVGINEPRH; |
| 6218. | KKHVGINEPRH; |
| 6219. | RKHVGINEPRH; |
| 6220. | HKHVGINEPRH; |
| 6221. | KRHVGINEPRH; |
| 6222. | RRHVGINEPRH; |
| 6223. | HRHVGINEPRH; |
| 6224. | KHKVGINEPRH; |
| 6225. | RHKVGINEPRH; |
| 6226. | HHKVGINEPRH; |
| 6227. | KKKVGINEPRH; |
| 6228. | RKKVGINEPRH; |
| 6229. | HKKVGINEPRH; |
| 6230. | KRKVGINEPRH; |
| 6231. | RRKVGINEPRH; |
| 6232. | HRKVGINEPRH; |
| 6233. | KHRVGINEPRH; |
| 6234. | RHRVGINEPRH; |
| 6235. | HHRVGINEPRH; |
| 6236. | KKRVGINEPRH; |
| 6237. | RKRVGINEPRH; |
| 6238. | HKRVGINEPRH; |
| 6239. | KRRVGINEPRH; |
| 6240. | RRRVGINEPRH; |
| 6241. | HRRVGINEPRH; |
| 6242. | KHHLGVNEPRH; |
| 6243. | RHHLGVNEPRH; |
| 6244. | HHHLGVNEPRH; |
| 6245. | KKHLGVNEPRH; |
| 6246. | RHHLGVNEPRH; |
| 6247. | HKHLGVNEPRH; |
| 6248. | KRHLGVNEPRH; |
| 6249. | RRHLGVNEPRH; |
| 6250. | HRHLGVNEPRH; |
| 6251. | KHKLGVNEPRH; |
| 6252. | RHKLGVNEPRH; |
| 6253. | HHKLGVNEPRH; |
| 6254. | KKKLGVNEPRH; |
| 6255. | RKKLGVNEPRH; |
| 6256. | HKKLGVNEPRH; |
| 6257. | KRKLGVNEPRH; |
| 6258. | RRKLGVNEPRH; |
| 6259. | HRKLGVNEPRH; |
| 6260. | KHRLGVNEPRH; |
| 6261. | RHRLGVNEPRH; |
| 6262. | HHRLGVNEPRH; |
| 6263. | KKRLGVNEPRH; |
| 6264. | RKRLGVNEPRH; |
| 6265. | HKRLGVNEPRH; |
| 6266. | KRRLGVNEPRH; |
| 6267. | RRRLGVNEPRH; |
| 6268. | HRRLGVNEPRH; |
| 6269. | KHHIGVNEPRH; |
| 6270. | RHHIGVNEPRH; |
| 6271. | HHHIGVNEPRH; |
| 6272. | KKHIGVNEPRH; |
| 6273. | RKHIGVNEPRH; |
| 6274. | HKHIGVNEPRH; |
| 6275. | KRHIGVNEPRH; |
| 6276. | RRHIGVNEPRH; |
| 6277. | HRHIGVNEPRH; |
| 6278. | KHKIGVNEPRH; |
| 6279. | RHKIGVNEPRH; |
| 6280. | HHKIGVNEPRH; |
| 6281. | KKKIGVNEPRH; |
| 6282. | RKKIGVNEPRH; |
| 6283. | HKKIGVNEPRH; |
| 6284. | KRKIGVNEPRH; |
| 6285. | RRKIGVNEPRH; |
| 6286. | HRKIGVNEPRH; |
| 6287. | KHRIGVNEPRH; |
| 6288. | RHRIGVNEPRH; |
| 6289. | HHRIGVNEPRH; |

TABLE 7-continued

SEQ ID NO. shown to left of sequence (cont'd)

| SEQ ID NO. | Sequence |
|---|---|
| 6290. | KKRIGVNEPRH; |
| 6291. | RKRIGVNEPRH; |
| 6292. | HKRIGVNEPRH; |
| 6293. | KRRIGVNEPRH; |
| 6294. | RRRIGVNEPRH; |
| 6295. | HRRIGVNEPRH; |
| 6296. | KHHVGVNEPRH; |
| 6297. | RHHVGVNEPRH; |
| 6298. | HHHVGVNEPRH; |
| 6299. | KKHVGVNEPRH; |
| 6300. | RKHVGVNEPRH; |
| 6301. | HKHVGVNEPRH; |
| 6302. | KRHVGVNEPRH; |
| 6303. | RRHVGVNEPRH; |
| 6304. | HRHVGVNEPRH; |
| 6305. | KHKVGVNEPRH; |
| 6306. | RHKVGVNEPRH; |
| 6307. | HHKVGVNEPRH; |
| 6308. | KKKVGVNEPRH; |
| 6309. | RKKVGVNEPRH; |
| 6310. | HKKVGVNEPRH; |
| 6311. | KRKVGVNEPRH; |
| 6312. | RRKVGVNEPRH; |
| 6313. | HRKVGVNEPRH; |
| 6314. | KHRVGVNEPRH; |
| 6315. | RHRVGVNEPRH; |
| 6316. | HHRVGVNEPRH; |
| 6317. | KKRVGVNEPRH; |
| 6318. | RKRVGVNEPRH; |
| 6319. | HKRVGVNEPRH; |
| 6320. | KRRVGVNEPRH; |
| 6321. | RRRVGVNEPRH; |
| 6322. | HRRVGVNEPRH; |
| 6323. | KHHLGLENPRH; |
| 6324. | RHHLGLENPRH; |
| 6325. | HHHLGLENPRH; |
| 6326. | KKHLGLENPRH; |
| 6327. | RKHLGLENPRH; |
| 6328. | HKHLGLENPRH; |
| 6329. | KRHLGLENPRH; |
| 6330. | RRHLGLENPRH; |
| 6331. | HRHLGLENPRH; |
| 6332. | KHKLGLENPRH; |
| 6333. | RHKLGLENPRH; |
| 6334. | HHKLGLENPRH; |
| 6335. | KKKLGLENPRH; |
| 6336. | RKKLGLENPRH; |
| 6337. | HKKLGLENPRH; |
| 6338. | KRKLGLENPRH; |
| 6339. | RRKLGLENPRH; |
| 6340. | HRKLGLENPRH; |
| 6341. | KHRLGLENPRH; |
| 6342. | RHRLGLENPRH; |
| 6343. | HHRLGLENPRH; |
| 6344. | KKRLGLENPRH; |
| 6345. | RKRLGLENPRH; |
| 6346. | HKRLGLENPRH; |
| 6347. | KRRLGLENPRH; |
| 6348. | RRRLGLENPRH; |
| 6349. | HRRLGLENPRH; |
| 6350. | KHHIGLENPRH; |
| 6351. | RHHIGLENPRH; |
| 6352. | HHHIGLENPRH; |
| 6353. | KKHIGLENPRH; |
| 6354. | RKHIGLENPRH; |
| 6355. | HKHIGLENPRH; |
| 6356. | KRHIGLENPRH; |
| 6357. | RRHIGLENPRH; |
| 6358. | HRHIGLENPRH; |
| 6359. | KHKIGLENPRH; |
| 6360. | RHKIGLENPRH; |
| 6361. | HHKIGLENPRH; |
| 6362. | KKKIGLENPRH; |
| 6363. | RKKIGLENPRH; |
| 6364. | HKKIGLENPRH; |
| 6365. | KRKIGLENPRH; |
| 6366. | RRKIGLENPRH; |
| 6367. | HRKIGLENPRH; |

TABLE 7-continued

SEQ ID NO. shown to left of sequence(cont'd)

| | |
|---|---|
| 6368. | KHRIGLENPRH; |
| 6369. | RHRIGLENPRH; |
| 6370. | HHRIGLENPRH; |
| 6371. | KKRIGLENPRH; |
| 6372. | RKRIGLENPRH; |
| 6373. | HKRIGLENPRH; |
| 6374. | KRRIGLENPRH; |
| 6375. | RRRIGLENPRH; |
| 6376. | HRRIGLENPRH; |
| 6377. | KHHVGLENPRH; |
| 6378. | RHHVGLENPRH; |
| 6379. | HHHVGLENPRH; |
| 6380. | KKHVGLENPRH; |
| 6381. | RKHVGLENPRH; |
| 6382. | HKHVGLENPRH; |
| 6383. | KRHVGLENPRH; |
| 6384. | RRHVGLENPRH; |
| 6385. | HRHVGLENPRH; |
| 6386. | KHKVGLENPRH; |
| 6387. | RHKVGLENPRH; |
| 6388. | HHKVGLENPRH; |
| 6389. | KKKVGLENPRH; |
| 6390. | RKKVGLENPRH; |
| 6391. | HKKVGLENPRH; |
| 6392. | KRKVGLENPRH; |
| 6393. | RRKVGLENPRH; |
| 6394. | HRKVGLENPRH; |
| 6395. | KHRVGLENPRH; |
| 6396. | RHRVGLENPRH; |
| 6397. | HHRVGLENPRH; |
| 6398. | KKRVGLENPRH; |
| 6399. | RKRVGLENPRH; |
| 6400. | HKRVGLENPRH; |
| 6401. | KRRVGLENPRH; |
| 6402. | RRRVGLENPRH; |
| 6403. | HRRVGLENPRH; |
| 6404. | KHHLGIENPRH; |
| 6405. | RHHLGIENPRH; |
| 6406. | HHHLGIENPRH; |

TABLE 7-continued

SEQ ID NO. shown to left of sequence(cont'd)

| | |
|---|---|
| 6407. | KKHLGIENPRH; |
| 6408. | RKHLGIENPRH; |
| 6409. | HKHLGIENPRH; |
| 6410. | KRHLGIENPRH; |
| 6411. | RRHLGIENPRH; |
| 6412. | HRHLGIENPRH; |
| 6413. | KHKLGIENPRH; |
| 6414. | RHKLGIENPRH; |
| 6415. | HHKLGIENPRH; |
| 6416. | KKKLGIENPRH; |
| 6417. | RKKLGIENPRH; |
| 6418. | HKKLGIENPRH; |
| 6419. | KRKLGIENPRH; |
| 6420. | RRKLGIENPRH; |
| 6421. | HRKLGIENPRH; |
| 6422. | KHRLGIENPRH; |
| 6423. | RHRLGIENPRH; |
| 6424. | HHRLGIENPRH; |
| 6425. | KKRLGIENPRH; |
| 6426. | RKRLGIENPRH; |
| 6427. | HKRLGIENPRH; |
| 6428. | KRRLGIENPRH; |
| 6429. | RRRLGIENPRH; |
| 6430. | HRRLGIENPRH; |
| 6431. | KHHIGIENPRH; |
| 6432. | RHHIGIENPRH; |
| 6433. | HHHIGIENPRH; |
| 6434. | KKHIGIENPRH; |
| 6435. | RKHIGIENPRH; |
| 6436. | HKHIGIENPRH; |
| 6437. | KRHIGIENPRH; |
| 6438. | RRHIGIENPRH; |
| 6439. | HRHIGIENPRH; |
| 6440. | KHKIGIENPRH; |
| 6441. | RHKIGIENPRH; |
| 6442. | HHKIGIENPRH; |
| 6443. | KKKIGIENPRH; |
| 6444. | RKKIGIENPRH; |
| 6445. | HKKIGIENPRH; |

TABLE 7-continued

SEQ ID NO. shown to left of sequence (cont'd)

| | |
|---|---|
| 6446. | KRKIGIENPRH; |
| 6447. | RRKIGIENPRH; |
| 6448. | HRKIGIENPRH; |
| 6449. | KHRIGIENPRH; |
| 6450. | RHRIGIENPRH; |
| 6451. | HHRIGIENPRH; |
| 6452. | KKRIGIENPRH; |
| 6453. | RKRIGIENPRH; |
| 6454. | HKRIGIENPRH; |
| 6455. | KRRIGIENPRH; |
| 6456. | RRRIGIENPRH; |
| 6457. | HRRIGIENPRH; |
| 6458. | KHHVGIENPRH; |
| 6459. | RHHVGIENPRH; |
| 6460. | HHHVGIENPRH; |
| 6461. | KKHVGIENPRH; |
| 6462. | RKHVGIENPRH; |
| 6463. | HKHVGIENPRH; |
| 6464. | KRHVGIENPRH; |
| 6465. | RRHVGIENPRH; |
| 6466. | HRHVGIENPRH; |
| 6467. | KHKVGIENPRH; |
| 6468. | RHKVGIENPRH; |
| 6469. | HHKVGIENPRH; |
| 6470. | KKKVGIENPRH; |
| 6471. | RKKVGIENPRH; |
| 6472. | HKKVGIENPRH; |
| 6473. | KRKVGIENPRH; |
| 6474. | RRKVGIENPRH; |
| 6475. | HRKVGIENPRH; |
| 6476. | KHRVGIENPRH; |
| 6477. | RHRVGIENPRH; |
| 6478. | HHRVGIENPRH; |
| 6479. | KKRVGIENPRH; |
| 6480. | RKRVGIENPRH; |
| 6481. | HKRVGIENPRH; |
| 6482. | KRRVGIENPRH; |
| 6483. | RRRVGIENPRH; |
| 6484. | HRRVGIENPRH; |

TABLE 7-continued

SEQ ID NO. shown to left of sequence (cont'd)

| | |
|---|---|
| 6485. | KHHLGVENPRH; |
| 6486. | RHHLGVENPRH; |
| 6487. | HHHLGVENPRH; |
| 6488. | KKHLGVENPRH; |
| 6489. | RKHLGVENPRH; |
| 6490. | HKHLGVENPRH; |
| 6491. | KRHLGVENPRH; |
| 6492. | RRHLGVENPRH; |
| 6493. | HRHLGVENPRH; |
| 6494. | KHKLGVENPRH; |
| 6495. | RHKLGVENPRH; |
| 6496. | HHKLGVENPRH; |
| 6497. | KKKLGVENPRH; |
| 6498. | RKKLGVENPRH; |
| 6499. | HKKLGVENPRH; |
| 6500. | KRKLGVENPRH; |
| 6501. | RRKLGVENPRH; |
| 6502. | HRKLGVENPRH; |
| 6503. | KHRLGVENPRH; |
| 6504. | RHRLGVENPRH; |
| 6505. | HHRLGVENPRH; |
| 6506. | KKRLGVENPRH; |
| 6507. | RKRLGVENPRH; |
| 6508. | HKRLGVENPRH; |
| 6509. | KRRLGVENPRH; |
| 6510. | RRRLGVENPRH; |
| 6511. | HRRLGVENPRH; |
| 6512. | KHHIGVENPRH; |
| 6513. | RHHIGVEEPRH; |
| 6514. | HHHIGVENPRH; |
| 6515. | KKHIGVENPRH; |
| 6516. | RKHIGVENPRH; |
| 6517. | HKHIGVENPRH; |
| 6518. | KRHIGVENPRH; |
| 6519. | RRHIGVENPRH; |
| 6520. | HRHIGVENPRH; |
| 6521. | KHKIGVENPRH; |
| 6522. | RHKIGVENPRH; |
| 6523. | HHKIGVENPRH; |

TABLE 7-continued

SEQ ID NO. shown to left of sequence(cont'd)

| | |
|---|---|
| 6524. | KKKIGVENPRH; |
| 6525. | RKKIGVENPRH; |
| 6526. | HKKIGVENPRH; |
| 6527. | KRKIGVENPRH; |
| 6528. | RRKIGVENPRH; |
| 6529. | HRKIGVENPRH; |
| 6530. | KHRIGVENPRH; |
| 6531. | RHRIGVENPRH; |
| 6532. | HHRIGVENPRH; |
| 6533. | KKRIGVENPRH; |
| 6534. | RKRIGVENPRH; |
| 6535. | HKRIGVENPRH; |
| 6536. | KRRIGVENPRH; |
| 6537. | RRRIGVENPRH; |
| 6538. | HRRIGVENPRH; |
| 6539. | KHHVGVENPRH; |
| 6540. | RHHVGVENPRH; |
| 6541. | HHHVGVENPRH; |
| 6542. | KKHVGVENPRH; |
| 6543. | RKHVGVENPRH; |
| 6544. | HKHVGVENPRH; |
| 6545. | KRHVGVENPRH; |
| 6546. | RRRVGVENPRH; |
| 6547. | HRHVGVENPRH; |
| 6548. | KHKVGVENPRH; |
| 6549. | RHKVGVENPRH; |
| 6550. | HHKVGVENPRH; |
| 6551. | KKKVGVENPRH; |
| 6552. | RKKVGVENPRH; |
| 6553. | HKKVGVENPRH; |
| 6554. | KRKVGVENPRH; |
| 6555. | RRKVGVEEPRH; |
| 6556. | HRKVGVENPRH; |
| 6557. | KHRVGVENPRH; |
| 6558. | RHRVGVENPRH; |
| 6559. | HHRVGVENPRH; |
| 6560. | KKRVGVENPRH; |
| 6561. | RKRVGVENPRH; |
| 6562. | HKRVGVENPRH; |

TABLE 7-continued

SEQ ID NO. shown to left of sequence(cont'd)

| | |
|---|---|
| 6563. | KRRVGVENPRH; |
| 6564. | RRRVGVENPRH; |
| 6565. | HRRVGVENPRH; |
| 6566. | KHHLGLNNPRH; |
| 6567. | RHHLGLNNPRH; |
| 6568. | HHHLGLNNPRH; |
| 6569. | KKHLGLNNPRH; |
| 6570. | RKHLGLNNPRH; |
| 6571. | HKHLGLNNPRH; |
| 6572. | KRHLGLNNPRH; |
| 6573. | RRHLGLNNPRH; |
| 6574. | HRHLGLNNPRH; |
| 6575. | KHKLGLNNPRH; |
| 6576. | RHKLGLNNPRH; |
| 6577. | HHKLGLNNPRH; |
| 6578. | KKKLGLNNPRH; |
| 6579. | RKKLGLNNPRH; |
| 6580. | HKKLGLNNPRH; |
| 6581. | KRKLGLNNPRH; |
| 6582. | RRKLGLNNPRH; |
| 6583. | HRKLGLNNPRH; |
| 6584. | KHRLGLNNPRH; |
| 6585. | RHRLGLNNPRH; |
| 6586. | HHRLGLNNPRH; |
| 6587. | KKRLGLNNPRH; |
| 6588. | RKRLGLNNPRH; |
| 6589. | HKRLGLNNPRH; |
| 6590. | KRRLGLNNPRH; |
| 6591. | RRRLGLNNPRH; |
| 6592. | HRRLGLNNPRH; |
| 6593. | KHHIGLNNPRH; |
| 6594. | RHHIGLNNPRH; |
| 6595. | HHHIGLNNPRH; |
| 6596. | KKHIGLNNPRH; |
| 6597. | RKHIGLNNPRH; |
| 6598. | HKHIGLNNPRH; |
| 6599. | KRHIGLNNPRH; |
| 6600. | RRHIGLNNPRH; |
| 6601. | HRHIGLNNPRH; |

TABLE 7-continued

SEQ ID NO. shown to left of sequence (cont'd)

| SEQ ID NO. | Sequence |
|---|---|
| 6602. | KHKIGLNNPRH; |
| 6603. | RHKIGLNNPRH; |
| 6604. | HHKIGLNNPRH; |
| 6605. | KKKIGLNNPRH; |
| 6606. | RKKIGLNNPRH; |
| 6607. | HKKIGLNNPRH; |
| 6608. | KRKIGLNNPRH; |
| 6609. | RRKIGLNNPRH; |
| 6610. | HRKIGLNNPRH; |
| 6611. | KHRIGLNNPRH; |
| 6612. | RHRIGLNNPRH; |
| 6613. | HHRIGLNNPRH; |
| 6614. | KKRIGLNNPRH; |
| 6615. | RKRIGLNNPRH; |
| 6616. | HKRIGLNNPRH; |
| 6617. | KRRIGLNNPRH; |
| 6618. | RRRIGLNNPRH; |
| 6619. | HRRIGLNNPRH; |
| 6620. | KHHVGLNNPRH; |
| 6621. | RHHVGLNNPRH; |
| 6622. | HHHVGLNNPRH; |
| 6623. | KKHVGLNNPRH; |
| 6624. | RKHVGLNNPRH; |
| 6625. | HKHVGLNNPRH; |
| 6626. | KRHVGLNNPRH; |
| 6627. | RRHVGLNNPRH; |
| 6628. | HRHVGLNNPRH; |
| 6629. | KHKVGLNNPRH; |
| 6630. | RHKVGLNNPRH; |
| 6631. | HHKVGLNNPRH; |
| 6632. | KKKVGLNNPRH; |
| 6633. | RKKVGLNNPRH; |
| 6634. | HKKVGLNNPRH; |
| 6635. | KRKVGLNNPRH; |
| 6636. | RRKVGLNNPRH; |
| 6637. | HRKVGLNNPRH; |
| 6638. | KHRVGLNNPRH; |
| 6639. | RHRVGLNNPRH; |
| 6640. | HHRVGLNNPRH; |
| 6641. | KKRVGLNNPRH; |
| 6642. | RKRVGLNNPRH; |
| 6643. | HKRVGLNNPRH; |
| 6644. | KRRVGLNNPRH; |
| 6645. | RRRVGLNNPRH; |
| 6646. | HRRVGLNNPRH; |
| 6647. | KHHLGLNNPRH; |
| 6648. | RHHLGINNPRH; |
| 6649. | HHHLGINNPRH; |
| 6650. | KKHLGINNPRH; |
| 6651. | RKHLGINNPRH; |
| 6652. | HKHLGINNPRH; |
| 6653. | KRHLGINNPRH; |
| 6654. | RRHLGINNPRH; |
| 6655. | HRHLGINNPRH; |
| 6656. | KHKLGINNPRH; |
| 6657. | RHKLGINNPRH; |
| 6658. | HHKLGINNPRH; |
| 6659. | KKKLGINNPRH; |
| 6660. | RKKLGINNPRH; |
| 6661. | HKKLGINNPRH; |
| 6662. | KRKLGINNPRH; |
| 6663. | RRKLGINNPRH; |
| 6664. | HRKLGINNPRH; |
| 6665. | KHRLGINNPRH; |
| 6666. | RHRLGINNPRH; |
| 6667. | HHRLGINNPRH; |
| 6668. | KKRLGINNPRH; |
| 6669. | RKRLGINNPRH; |
| 6670. | HKRLGINNPRH; |
| 6671. | KRRLGINNPRH; |
| 6672. | RRRLGINNPRH; |
| 6673. | HRRLGINNPRH; |
| 6674. | KHHIGIENPRH; |
| 6675. | RHHIGINNPRH; |
| 6676. | HHHIGINNPRH; |
| 6677. | KKHIGINNPRH; |
| 6678. | RKHIGINNPRH; |
| 6679. | HKHIGINNPRH; |

TABLE 7-continued

SEQ ID NO. shown to left of sequence(cont'd)

| | |
|---|---|
| 6680. | KRHIGINNPRH; |
| 6681. | RRHIGINNPRH; |
| 6682. | HRHIGINNPRH; |
| 6683. | KHKIGINNPRH; |
| 6684. | RHKIGINNPRH; |
| 6685. | HHKIGINNPRH; |
| 6686. | KKKIGINNPRH; |
| 6687. | RKKIGINNPRH; |
| 6688. | HKKIGINNPRH; |
| 6689. | KRKIGINNPRH; |
| 6690. | RRKIGINNPRH; |
| 6691. | HRKIGINNPRH; |
| 6692. | KHRIGINNPRH; |
| 6693. | RHRIGINNPRH; |
| 6694. | HHRIGINNPRH; |
| 6695. | KKRIGINNPRH; |
| 6696. | RKRIGINNPRH; |
| 6697. | HKRIGINNPRH; |
| 6698. | KRRIGINNPRH; |
| 6699. | RRRIGINNPRH; |
| 6700. | HRRIGINNPRH; |
| 6701. | KHHVGINNPRH; |
| 6702. | RHHVGINNPRH; |
| 6703. | HHHVGINNPRH; |
| 6704. | KKHVGINNPRH; |
| 6705. | RKHVGLNNPRH; |
| 6706. | HKHVGINNPRH; |
| 6707. | KRHVGINNPRH; |
| 6708. | RRHVGINNPRH; |
| 6709. | HRHVGINNPRH; |
| 6710. | KHKVGINNPRH; |
| 6711. | RHKVGINNPRH; |
| 6712. | HHKVGINNPRH; |
| 6713. | KKKVGINNPRH; |
| 6714. | RKKVGINNPRH; |
| 6715. | HKKVGINNPRH; |
| 6716. | KRKVGINNPRH; |
| 6717. | RRKVGINNPRH; |
| 6718. | HRKVGINNPRH; |

TABLE 7-continued

SEQ ID NO. shown to left of sequence(cont'd)

| | |
|---|---|
| 6719. | KHRVGINNPRH; |
| 6720. | RHRVGINNPRH; |
| 6721. | HHRVGINNPRH; |
| 6722. | KKRVGINNPRH; |
| 6723. | RKRVGINNPRH; |
| 6724. | HKRVGINNPRH; |
| 6725. | KRRVGINNPRH; |
| 6726. | RRRVGINNPRH; |
| 6727. | HRRVGINNPRH; |
| 6728. | KHHLGVNNPRH; |
| 6729. | RHHLGVNNPRH; |
| 6730. | HHHLGVNNPRH; |
| 6731. | KKHLGVNNPRH; |
| 6732. | RKHLGVNNPRH; |
| 6733. | HHHLGVNNPRH; |
| 6734. | KRHLGVNNPRH; |
| 6735. | RRHLGVNNPRH; |
| 6736. | HRHLGVNNPRH; |
| 6737. | KHKLGVNNPRH; |
| 6738. | RHKLGVNNPRH; |
| 6739. | HHKLGVNNPRH; |
| 6740. | KKKLGVNNPRH; |
| 6741. | RKKLGVNNPRH; |
| 6742. | HKKLGVNNPRH; |
| 6743. | KRKLGVNNPRH; |
| 6744. | RRKLGVNNPRH; |
| 6745. | HRKLGVNNPRH; |
| 6746. | KHRLGVNNPRH; |
| 6747. | RHRLGVNNPRH; |
| 6748. | HHRLGVNNPRH; |
| 6749. | KKRLGVNNPRH; |
| 6750. | RKRLGVNNPRH; |
| 6751. | HKRLGVNNPRH; |
| 6752. | KRRLGVNNPRH; |
| 6753. | RRRLGVNNPRH; |
| 6754. | HRRLGVNNPRH; |
| 6755. | KHHIGVNNPRH; |
| 6756. | RHHIGVNNPRH; |
| 6757. | HHHIGVNNPRH; |

TABLE 7-continued

SEQ ID NO. shown to left of sequence(cont'd)

| SEQ ID NO. | Sequence |
|---|---|
| 6758. | KKHIGVNNPRH; |
| 6759. | RKHIGVNNPRH; |
| 6760. | HKHIGVNNPRH; |
| 6761. | KRHIGVNNPRH; |
| 6762. | RRHIGVNNPRH; |
| 6763. | HRHIGVNNPRH; |
| 6764. | KHKIGVNNPRH; |
| 6765. | RHKIGVNNPRH; |
| 6766. | HHKIGVNNPRH; |
| 6767. | KKKIGVNNPRH; |
| 6768. | RKKIGVNNPRH; |
| 6769. | HKKIGVNNPRH; |
| 6770. | KRKIGVNNPRH; |
| 6771. | RRKIGVNNPRH; |
| 6772. | HRKIGVNNPRH; |
| 6773. | KHRIGVNNPRH; |
| 6774. | RHRIGVNNPRH; |
| 6775. | HHRIGVNNPRH; |
| 6776. | KKRIGVNNPRH; |
| 6777. | RKRIGVNNPRH; |
| 6778. | HKRIGVNNPRH; |
| 6779. | KRRIGVNNPRH; |
| 6780. | RRRIGVNNPRH; |
| 6781. | HRRIGVNNPRH; |
| 6782. | KHHVGVNNPRH; |
| 6783. | RHHVGVNNPRH; |
| 6784. | HHHVGVNNPRH; |
| 6785. | KKHVGVNNPRH; |
| 6786. | RKHVGVNNPRH; |
| 6787. | HKHVGVNNPRH; |
| 6788. | KRHVGVNNPRH; |
| 6789. | RRHVGVNNPRH; |
| 6790. | HRHVGVNNPRH; |
| 6791. | KHKVGVNNPRH; |
| 6792. | RHKVGVNNPRH; |
| 6793. | HHKVGVNNPRH; |
| 6794. | KKKVGVNNPRH; |
| 6795. | RKKVGVNNPRH; |
| 6796. | HKKVGVNNPRH; |
| 6797. | KRKVGVNNPRH; |
| 6798. | RRKVGVNNPRH; |
| 6799. | HRKVGVNNPRH; |
| 6800. | KHRVGVNNPRH; |
| 6801. | RHRVGVNNPRH; |
| 6802. | HHRVGVNNPRH; |
| 6803. | KKRVGVNNPRH; |
| 6804. | RKRVGVNNPRH; |
| 6805. | HKRVGVNNPRH; |
| 6806. | KRRVGVNNPRH; |
| 6807. | RRRVGVNNPRH; |
| 6808. | HRRVGVNNPRH; |
| 6809. | KHHLGLEEPHR; |
| 6810. | RHHLGLEEPHR; |
| 6811. | HHHLGLEEPHR; |
| 6812. | KKHLGLEEPHR; |
| 6813. | RKHLGLEEPHR; |
| 6814. | HKHLGLEEPHR; |
| 6815. | KRHLGLEEPHR; |
| 6816. | RRHLGLEEPHR; |
| 6817. | HRHLGLEEPHR; |
| 6818. | KHKLGLEEPHR; |
| 6819. | RHKLGLEEPHR; |
| 6820. | HHKLGLEEPHR; |
| 6821. | KKKLGLEEPHR; |
| 6822. | RKKLGLEEPHR; |
| 6823. | HKKLGLEEPHR; |
| 6824. | KRKLGLEEPHR; |
| 6825. | RRKLGLEEPHR; |
| 6826. | HRKLGLEEPHR; |
| 6827. | KHRLGLEEPHR; |
| 6828. | RHRLGLEEPHR; |
| 6829. | HHRLGLEEPHR; |
| 6830. | KKRLGLEEPHR; |
| 6831. | RKRLGLEEPHR; |
| 6832. | HKRLGLEEPHR; |
| 6833. | KRRLGLEEPHR; |
| 6834. | RRRLGLEEPHR; |
| 6835. | HRRLGLEEPHR; |

TABLE 7-continued

SEQ ID NO. shown to left of sequence(cont'd)

| | |
|---|---|
| 6836. | KHHIGLEEPHR; |
| 6837. | RHHIGLEEPHR; |
| 6838. | HHHIGLEEPHR; |
| 6839. | KKHIGLEEPHR; |
| 6840. | RKHIGLEEPHR; |
| 6841. | HKHIGLEEPHR; |
| 6842. | KRHIGLEEPHR; |
| 6843. | RRHIGLEEPHR; |
| 6844. | HRHIGLEEPHR; |
| 6845. | KHKIGLEEPHR; |
| 6846. | RHKIGLEEPHR; |
| 6847. | HHKIGLEEPHR; |
| 6848. | KKKIGLEEPHR; |
| 6849. | RKKIGLEEPHR; |
| 6850. | HKKIGLEEPHR; |
| 6851. | KRKIGLEEPHR; |
| 6852. | RRKIGLEEPHR; |
| 6853. | HRKIGLEEPHR; |
| 6854. | KHRIGLEEPHR; |
| 6855. | RHRIGLEEPHR; |
| 6856. | HHRIGLEEPHR; |
| 6857. | KKRIGLEEPHR; |
| 6858. | RKRIGLEEPHR; |
| 6859. | HKRIGLEEPHR; |
| 6860. | KRRIGLEEPHR; |
| 6861. | RRRIGLEEPHR; |
| 6862. | HRRIGLEEPHR; |
| 6863. | KHHVGLEEPHR; |
| 6864. | RHHVGLEEPHR; |
| 6865. | HHHVGLEEPHR; |
| 6866. | KKHVGLEEPHR; |
| 6867. | RKHVGLEEPHR; |
| 6868. | HKHVGLEEPHR; |
| 6869. | KRHVGLEEPHR; |
| 6870. | RRHVGLEEPHR; |
| 6871. | HRHVGLEEPHR; |
| 6872. | KHKVGLEEPHR; |
| 6873. | RHKVGLEEPHR; |
| 6874. | HHKVGLEEPHR; |

TABLE 7-continued

SEQ ID NO. shown to left of sequence(cont'd)

| | |
|---|---|
| 6875. | KKKVGLEEPHR; |
| 6876. | RKKVGLEEPHR; |
| 6877. | HKKVGLEEPHR; |
| 6878. | KRKVGLEEPHR; |
| 6879. | RRKVGLEEPHR; |
| 6880. | HRKVGLEEPHR; |
| 6881. | KHRVGLEEPHR; |
| 6882. | RHRVGLEEPHR; |
| 6883. | HHRVGLEEPHR; |
| 6884. | KKRVGLEEPHR; |
| 6885. | RKRVGLEEPHR; |
| 6886. | HKRVGLEEPHR; |
| 6887. | KRRVGLEEPHR; |
| 6888. | RRRVGLEEPHR; |
| 6889. | HRRVGLEEPHR; |
| 6890. | KHHLGIEEPHR; |
| 6891. | RHHLGIEEPHR; |
| 6892. | HHHLGIEEPHR; |
| 6893. | KKHLGIEEPHR; |
| 6894. | RKHLGIEEPHR; |
| 6895. | HKHLGIEEPHR; |
| 6896. | KRHLGIEEPHR; |
| 6897. | RRHLGIEEPHR; |
| 6898. | HRHLGIEEPHR; |
| 6899. | KHKLGIEEPHR; |
| 6900. | RHKLGIEEPHR; |
| 6901. | HHKLGIEEPHR; |
| 6902. | KKKLGIEEPHR; |
| 6903. | RKKLGIEEPHR; |
| 6904. | HKKLGIEEPHR; |
| 6905. | KRKLGIEEPHR; |
| 6906. | RRKLGIEEPHR; |
| 6907. | HRKLGIEEPHR; |
| 6908. | KHRLGIEEPHR; |
| 6909. | RHRLGIEEPHR; |
| 6910. | HHRLGIEEPHR; |
| 6911. | KKRLGIEEPHR; |
| 6912. | RKRLGIEEPHR; |
| 6913. | HKRLGIEEPHR; |

TABLE 7-continued

SEQ ID NO. shown to left of sequence(cont'd)

| | |
|---|---|
| 6914. | KRRLGIEEPHR; |
| 6915. | RRRLGIEEPHR; |
| 6916. | HRRLGIEEPHR; |
| 6917. | KHHIGIEEPHR; |
| 6918. | RHHIGIEEPHR; |
| 6919. | HHHIGIEEPHR; |
| 6920. | KKHIGIEEPHR; |
| 6921. | RKHIGIEEPHR; |
| 6922. | HKHIGIEEPHR; |
| 6923. | KRHIGIEEPHR; |
| 6924. | RRHIGIEEPHR; |
| 6925. | HRHIGIEEPHR; |
| 6926. | KHKIGIEEPHR; |
| 6927. | RHKIGIEEPHR; |
| 6928. | HHKIGIEEPHR; |
| 6929. | KKKIGIEEPHR; |
| 6930. | RKKIGIEEPHR; |
| 6931. | HKKIGIEEPHR; |
| 6932. | KRKIGIEEPHR; |
| 6933. | RRKIGIEEPHR; |
| 6934. | HRKIGIEEPHR; |
| 6935. | KHRIGIEEPHR; |
| 6936. | RHRIGIEEPHR; |
| 6937. | HHRIGIEEPHR; |
| 6938. | KKRIGIEEPHR; |
| 6939. | RKRIGIEEPHR; |
| 6940. | HKRIGIEEPHR; |
| 6941. | KRRIGIEEPHR; |
| 6942. | RRRIGIEEPHR; |
| 6943. | HRRIGIEEPHR; |
| 6944. | KHHVGIEEPHR; |
| 6945. | RHHVGIEEPHR; |
| 6946. | HHHVGIEEPHR; |
| 6947. | KKHVGIEEPHR; |
| 6948. | RKHVGIEEPHR; |
| 6949. | HKHVGIEEPHR; |
| 6950. | KRHVGIEEPHR; |
| 6951. | RRHVGIEEPHR; |
| 6952. | HRHVGIEEPHR; |

TABLE 7-continued

SEQ ID NO. shown to left of sequence(cont'd)

| | |
|---|---|
| 6953. | KHKVGIEEPHR; |
| 6954. | RHKVGIEEPHR; |
| 6955. | HHKVGIEEPHR; |
| 6956. | KKKVGIEEPHR; |
| 6957. | RKKVGIEEPHR; |
| 6958. | HKKVGIEEPHR; |
| 6959. | KRKVGIEEPHR; |
| 6960. | RRKVGIEEPHR; |
| 6961. | HRKVGIEEPHR; |
| 6962. | KHRVGIEEPHR; |
| 6963. | RHRVGIEEPHR; |
| 6964. | HHRVGIEEPHR; |
| 6965. | KKRVGIEEPHR; |
| 6966. | RKRVGIEEPHR; |
| 6967. | HKRVGIEEPHR; |
| 6968. | KRRVGIEEPHR; |
| 6969. | RRRVGIEEPHR; |
| 6970. | HRRVGIEEPHR; |
| 6971. | KHHLGVEEPHR; |
| 6972. | RHHLGVEEPHR; |
| 6973. | HHHLGVEEPHR; |
| 6974. | KKHLGVEEPHR; |
| 6975. | RKHLGVEEPHR; |
| 6976. | HKHLGVEEPHR; |
| 6977. | KRHLGVEEPHR; |
| 6978. | RRHLGVEEPHR; |
| 6979. | HRHLGVEEPHR; |
| 6980. | KHKLGVEEPHR; |
| 6981. | RHKLGVEEPHR; |
| 6982. | HHKLGVEEPHR; |
| 6983. | KKKLGVEEPHR; |
| 6984. | RKKLGVEEPHR; |
| 6985. | HKKLGVEEPHR; |
| 6986. | KRKLGVEEPHR; |
| 6987. | RRKLGVEEPHR; |
| 6988. | HRKLGVEEPHR; |
| 6989. | KHRLGVEEPHR; |
| 6990. | RHRLGVEEPHR; |
| 6991. | HHRLGVEEPHR; |

TABLE 7-continued

SEQ ID NO. shown to left of sequence(cont'd)

| | |
|---|---|
| 6992. | KKRLGVEEPHR; |
| 6993. | RKRLGVEEPHR; |
| 6994. | HKRLGVEEPHR; |
| 6995. | KRRLGVEEPHR; |
| 6996. | RRRLGVEEPHR; |
| 6997. | HRRLGVEEPHR; |
| 6998. | KHHIGVEEPHR; |
| 6999. | RHHIGVEEPHR; |
| 7000. | HHHIGVEEPHR; |
| 7001. | KKHIGVEEPHR; |
| 7002. | RKHIGVEEPHR; |
| 7003. | HKHIGVEEPHR; |
| 7004. | KRHIGVEEPHR; |
| 7005. | RRHIGVEEPHR; |
| 7006. | HRHIGVEEPHR; |
| 7007. | KHKIGVEEPHR; |
| 7008. | RHKIGVEEPHR; |
| 7009. | HHKIGVEEPHR; |
| 7010. | KKKIGVEEPHR; |
| 7011. | RKKIGVEEPHR; |
| 7012. | HKKIGVEEPHR; |
| 7013. | KRKIGVEEPHR; |
| 7014. | RRKIGVEEPHR; |
| 7015. | HRKIGVEEPHR; |
| 7016. | KHRIGVEEPHR; |
| 7017. | RHRIGVEEPHR; |
| 7018. | HHRIGVEEPHR; |
| 7019. | KKRIGVEEPHR; |
| 7020. | RKRIGVEEPHR; |
| 7021. | HKRIGVEEPHR; |
| 7022. | KRRIGVEEPHR; |
| 7023. | RRRIGVEEPHR; |
| 7024. | HRRIGVEEPHR; |
| 7025. | KHHVGVEEPHR; |
| 7026. | RHHVGVEEPHR; |
| 7027. | HHHVGVEEPHR; |
| 7028. | KKHVGVEEPHR; |
| 7029. | RKHVGVEEPHR; |
| 7030. | HKHVGVEEPHR; |

TABLE 7-continued

SEQ ID NO. shown to left of sequence(cont'd)

| | |
|---|---|
| 7031. | KRHVGVEEPHR; |
| 7032. | RRHVGVEEPHR; |
| 7033. | HRHVGVEEPHR; |
| 7034. | KHKVGVEEPHR; |
| 7035. | RHKVGVEEPHR; |
| 7036. | HHKVGVEEPHR; |
| 7037. | KKKVGVEEPHR; |
| 7038. | RKKVGVEEPHR; |
| 7039. | HKKVGVEEPHR; |
| 7040. | KRKVGVEEPHR; |
| 7041. | RRKVGVEEPHR; |
| 7042. | HRKVGVEEPHR; |
| 7043. | KHRVGVEEPHR; |
| 7044. | RHRVGVEEPHR; |
| 7045. | HHRVGVEEPHR; |
| 7046. | KKRVGVEEPHR; |
| 7047. | RKRVGVEEPHR; |
| 7048. | HKRVGVEEPHR; |
| 7049. | KRRVGVEEPHR; |
| 7050. | RRRVGVEEPHR; |
| 7051. | HRRVGVEEPHR; |
| 7052. | KHHLGLNEPHR; |
| 7053. | RHHLGLNEPHR; |
| 7054. | HHHLGLNEPHR; |
| 7055. | KKHLGLNEPHR; |
| 7056. | RKHLGLNEPHR; |
| 7057. | HKHLGLNEPHR; |
| 7058. | KRHLGLNEPHR; |
| 7059. | RRHLGLNEPHR; |
| 7060. | HRHLGLNEPHR; |
| 7061. | KHKLGLNEPHR; |
| 7062. | RHKLGLNEPHR; |
| 7063. | HHKLGLNEPHR; |
| 7064. | KKKLGLNEPHR; |
| 7065. | RKKLGLNEPHR; |
| 7066. | HKKLGLNEPHR; |
| 7067. | KRKLGLNEPHR; |
| 7068. | RRKLGLNEPHR; |
| 7069. | HRKLGLNEPHR; |

TABLE 7-continued

SEQ ID NO. shown to left of sequence(cont'd)

| SEQ ID NO. | Sequence |
|---|---|
| 7070. | KHRLGLNEPHR; |
| 7071. | RHRLGLNEPHR; |
| 7072. | HHRLGLNEPHR; |
| 7073. | KKRLGLNEPHR; |
| 7074. | RKRLGLNEPHR; |
| 7075. | HKRLGLNEPHR; |
| 7076. | KRRLGLNEPHR; |
| 7077. | RRRLGLNEPHR; |
| 7078. | HRRLGLNEPHR; |
| 7079. | KHHIGLNPHR; |
| 7080. | RHHIGLNEPHR; |
| 7081. | HHHIGLNEPHR; |
| 7082. | KKHIGLNEPHR; |
| 7083. | RKHIGLNEPHR; |
| 7084. | HKHIGLNEPHR; |
| 7085. | KRHIGLNEPHR; |
| 7086. | RRHIGLNEPHR; |
| 7087. | HRHIGLNEPHR; |
| 7088. | KHKIGLNEPHR; |
| 7089. | RHKIGLNEPHR; |
| 7090. | HHKIGLNEPHR; |
| 7091. | KKKIGLNEPHR; |
| 7092. | RKKIGLNEPHR; |
| 7093. | HKKIGLNEPHR; |
| 7094. | KRKIGLNEPHR; |
| 7095. | RRKIGLNEPHR; |
| 7096. | HRKIGLNEPHR; |
| 7097. | KHRIGLNEPHR; |
| 7098. | RHRIGLNEPHR; |
| 7099. | HHRIGLNEPHR; |
| 7100. | KKRIGLNEPHR; |
| 7101. | RKRIGLNEPHR; |
| 7102. | HKRIGLNEPHR; |
| 7103. | KRRIGLNEPHR; |
| 7104. | RRRIGLNEPHR; |
| 7105. | HRRIGLNEPHR; |
| 7106. | KHHVGLNEPHR; |
| 7107. | RHHVGLNEPHR; |
| 7108. | HHHVGLNEPHR; |
| 7109. | KKHVGLNEPHR; |
| 7110. | RKHVGLNEPHR; |
| 7111. | HKHVGLNEPHR; |
| 7112. | KRHVGLNEPHR; |
| 7113. | RRHVGLNEPHR; |
| 7114. | HRHVGLNEPHR; |
| 7115. | KHKVGLNEPHR; |
| 7116. | RHKVGLNEPHR; |
| 7117. | HHKVGLNEPHR; |
| 7118. | KKKVGLNEPHR; |
| 7119. | RKKVGLNEPHR; |
| 7120. | HKKVGLNEPHR; |
| 7121. | KRKVGLNEPHR; |
| 7122. | RRKVGLNEPHR; |
| 7123. | HRKVGLNEPHR; |
| 7124. | KHRVGLNEPHR; |
| 7125. | RHRVGLNEPHR; |
| 7126. | HHRVGLNEPHR; |
| 7127. | KKRVGLNEPHR; |
| 7128. | RKRVGLNEPHR; |
| 7129. | HKRVGLNEPHR; |
| 7130. | KRRVGLNEPHR; |
| 7131. | RRRVGLNEPHR; |
| 7132. | HRRVGLNEPHR; |
| 7133. | KHHLGINEPHR; |
| 7134. | RHHLGINEPHR; |
| 7135. | HHHLGINEPHR; |
| 7136. | KKHLGINEPHR; |
| 7137. | RKHLGINEPHR; |
| 7138. | HKHLGINEPHR; |
| 7139. | KRHLGINEPHR; |
| 7140. | RRHLGINEPHR; |
| 7141. | HRHLGINEPHR; |
| 7142. | KHKLGINEPHR; |
| 7143. | RHKLGINEPHR; |
| 7144. | HHKLGINEPHR; |
| 7145. | KKKLGINEPHR; |
| 7146. | RKKLGINEPHR; |
| 7147. | HKKLGINEPHR; |

TABLE 7-continued

SEQ ID NO. shown to left of sequence (cont'd)

| | |
|---|---|
| 7148. | KRKLGINEPHR; |
| 7149. | RRKLGINEPHR; |
| 7150. | HRKLGINEPHR; |
| 7151. | KHRLGINEPHR; |
| 7152. | RHRLGINEPHR; |
| 7153. | HHRLGINEPHR; |
| 7154. | KKRLGINEPHR; |
| 7155. | RKRLGINEPHR; |
| 7156. | HKRLGLNEPHR; |
| 7157. | KRRLGINEPHR; |
| 7158. | RRRLGINEPHR; |
| 7159. | HRRLGINEPHR; |
| 7160. | KHHIGIENPHR; |
| 7161. | RHHIGINEPHR; |
| 7162. | HHHIGINEPHR; |
| 7163. | KKHIGINEPHR; |
| 7164. | RKHIGLNEPHR; |
| 7165. | HKHIGINEPHR; |
| 7166. | KRHLGINEPHR; |
| 7167. | RRHIGINEPHR; |
| 7168. | HRHIGINEPHR; |
| 7169. | KHKIGINEPHR; |
| 7170. | RHKIGINEPHR; |
| 7171. | HHKIGINEPHR; |
| 7172. | KKKIGINEPHR; |
| 7173. | RKKIGINEPHR; |
| 7174. | HKKIGINEPHR; |
| 7175. | KRKIGINEPHR; |
| 7176. | RRKIGINEPHR; |
| 7177. | HRKIGINEPHR; |
| 7178. | KHRIGINEPHR; |
| 7179. | RHRIGINEPHR; |
| 7180. | HHRIGINEPHR; |
| 7181. | KKRIGINEPHR; |
| 7182. | RKRIGINEPHR; |
| 7183. | HKRIGINEPHR; |
| 7184. | KRRIGINEPHR; |
| 7185. | RRRIGINEPHR; |
| 7186. | HRRIGINEPHR; |

TABLE 7-continued

SEQ ID NO. shown to left of sequence (cont'd)

| | |
|---|---|
| 7187. | KHHVGINEPHR; |
| 7188. | RHHVGINEPHR; |
| 7189. | HHHVGINEPHR; |
| 7190. | KKHVGINEPHR; |
| 7191. | RKHVGINEPHR; |
| 7192. | HKHVGINEPHR; |
| 7193. | KRHVGINEPHR; |
| 7194. | RRHVGINEPHR; |
| 7195. | HRHVGINEPHR; |
| 7196. | KHKVGINEPHR; |
| 7197. | RHKVGINEPHR; |
| 7198. | HHKVGINEPHR; |
| 7199. | KKKVGINEPHR; |
| 7200. | RKHVGINEPHR; |
| 7201. | HKKVGINEPHR; |
| 7202. | KRKVGINEPHR; |
| 7203. | RRKVGINEPHR; |
| 7204. | HRKVGINEPHR; |
| 7205. | KHRVGINEPHR; |
| 7206. | RHRVGINEPHR; |
| 7207. | HHRVGINEPHR; |
| 7208. | KKRVGINEPHR; |
| 7209. | RKRVGINEPHR; |
| 7210. | HKRVGINEPHR; |
| 7211. | KRRVGINEPHR; |
| 7212. | RRRVGINEPHR; |
| 7213. | HRRVGINEPHR; |
| 7214. | KHHLGVNEPHR; |
| 7215. | RHHLGVNEPHR; |
| 7216. | HHHLGVNEPHR; |
| 7217. | KKHLGVNEPHR; |
| 7218. | RKHLGVNEPHR; |
| 7219. | HKHLGVNEPHR; |
| 7220. | KRHLGVNEPHR; |
| 7221. | RRHLGVNEPHR; |
| 7222. | HRHLGVNEPHR; |
| 7223. | KHKLGVNEPHR; |
| 7224. | RHKLGVNEPHR; |
| 7225. | HHKLGVNEPHR; |

TABLE 7-continued

SEQ ID NO. shown to left of sequence(cont'd)

| | |
|---|---|
| 7226. | KKKLGVNEPHR; |
| 7227. | RKKLGVNEPHR; |
| 7228. | HKKLGVNEPHR; |
| 7229. | KRKLGVNEPHR; |
| 7230. | RRKLGVNEPHR; |
| 7231. | HRKLGVNEPHR; |
| 7232. | KHRLGVNEPHR; |
| 7233. | RHRLGVNEPHR; |
| 7234. | HHRLGVNEPHR; |
| 7235. | KKRLGVNEPHR; |
| 7236. | RKRLGVNEPHR; |
| 7237. | HKRLGVNEPHR; |
| 7238. | KRRLGVNEPHR; |
| 7239. | RRRLGVNEPHR; |
| 7240. | HRRLGVNEPHR; |
| 7241. | KHHIGVNEPHR; |
| 7242. | RHHIGVNEPHR; |
| 7243. | HHHIGVNEPHR; |
| 7244. | KKHIGVNEPHR; |
| 7245. | RKHIGVNEPHR; |
| 7246. | HKHIGVNEPHR; |
| 7247. | KRHIGVNEPHR; |
| 7248. | RRHIGVNEPHR; |
| 7249. | HRHIGVNEPHR; |
| 7250. | KHKIGVNEPHR; |
| 7251. | RHKIGVNEPHR; |
| 7252. | HHKIGVNEPHR; |
| 7253. | KKKIGVNEPHR; |
| 7254. | RKKIGVNEPHR; |
| 7255. | HKKIGVNEPHR; |
| 7256. | KRKIGVNEPHR; |
| 7257. | RRKIGVNEPHR; |
| 7258. | HRKIGVNEPHR; |
| 7259. | KHRIGVNEPHR; |
| 7260. | RHRIGVNEPHR; |
| 7261. | HHRIGVNEPHR; |
| 7262. | KKRIGVNEPHR; |
| 7263. | RKRIGVNEPHR; |
| 7264. | HKRIGVNEPHR; |
| 7265. | KRRIGVNEPHR; |
| 7266. | RRRIGVNEPHR; |
| 7267. | HRRIGVNEPHR; |
| 7268. | KHHVGVNEPHR; |
| 7269. | RHHVGVNEPHR; |
| 7270. | HHHVGVNEPHR; |
| 7271. | KKHVGVNEPHR; |
| 7272. | RKHVGVNEPHR; |
| 7273. | HKHVGVNEPHR; |
| 7274. | KRHVGVNEPHR; |
| 7275. | RRHVGVNEPHR; |
| 7276. | HRHVGVNEPHR; |
| 7277. | KHKVGVNEPHR; |
| 7278. | RHKVGVNEPHR; |
| 7279. | HHKVGVNEPHR; |
| 7280. | KKKVGVNEPHR; |
| 7281. | RKKVGVNEPHR; |
| 7282. | HKKVGVNEPHR; |
| 7283. | KRKVGVNEPHR; |
| 7284. | RRKVGVNEPHR; |
| 7285. | HRKVGVNEPHR; |
| 7286. | KHRVGVNEPHR; |
| 7287. | RHRVGVNEPHR; |
| 7288. | HHRVGVNEPHR; |
| 7289. | KKRVGVNEPHR; |
| 7290. | RKRVGVNEPHR; |
| 7291. | HKRVGVNEPHR; |
| 7292. | KRRVGVNEPHR; |
| 7293. | RRRVGVNEPHR; |
| 7294. | HRRVGVNEPHR; |
| 7295. | KHHLGLENPHR; |
| 7296. | RHHLGLENPHR; |
| 7297. | HHHLGLENPHR; |
| 7298. | KKHLGLENPHR; |
| 7299. | RKHLGLENPHR; |
| 7300. | HKHLGLENPHR; |
| 7301. | KRHLGLENPHR; |
| 7302. | RRHLGLENPHR; |
| 7303. | HRHLGLENPHR; |

TABLE 7-continued

SEQ ID NO. shown to left of sequence(cont'd)

| | |
|---|---|
| 7304. | KHKLGLENPHR; |
| 7305. | RHKLGLENPHR; |
| 7306. | HHKLGLENPHR; |
| 7307. | KKKLGLENPHR; |
| 7308. | RKKLGLENPHR; |
| 7309. | HKKLGLENPHR; |
| 7310. | KRKLGLENPHR; |
| 7311. | RRKLGLENPHR; |
| 7312. | HRKLGLENPHR; |
| 7313. | KHRLGLENPHR; |
| 7314. | RHRLGLENPHR; |
| 7315. | HHRLGLENPHR; |
| 7316. | KKRLGLENPHR; |
| 7317. | RKRLGLENPHR; |
| 7318. | HKRLGLENPHR; |
| 7319. | KRRLGLENPHR; |
| 7320. | RRRLGLENPHR; |
| 7321. | HRRLGLENPHR; |
| 7322. | KHHIGLENPHR; |
| 7323. | RHHIGLENPHR; |
| 7324. | HHHIGLENPHR; |
| 7325. | KKHIGLENPHR; |
| 7326. | RKHIGLENPHR; |
| 7327. | HKHIGLENPHR; |
| 7328. | KRHIGLENPHR; |
| 7329. | RRHIGLENPHR; |
| 7330. | HRHIGLENPHR; |
| 7331. | KHKIGLENPHR; |
| 7332. | RHKIGLENPHR; |
| 7333. | HHKIGLENPHR; |
| 7334. | KKKIGLENPHR; |
| 7335. | RKKIGLENPHR; |
| 7336. | HKKIGLENPHR; |
| 7337. | KRKIGLENPHR; |
| 7338. | RRKIGLENPHR; |
| 7339. | HRKIGLENPHR; |
| 7340. | KHRIGLENPHR; |
| 7341. | RHRIGLENPHR; |
| 7342. | HHRIGLENPHR; |
| 7343. | KKRIGLENPHR; |
| 7344. | RKRIGLENPHR; |
| 7345. | HKRIGLENPHR; |
| 7346. | KRRIGLENPHR; |
| 7347. | RRRIGLENPHR; |
| 7348. | HRRIGLENPHR; |
| 7349. | KHHVGLENPHR; |
| 7350. | RHHVGLENPHR; |
| 7351. | HHHVGLENPHR; |
| 7352. | KKHVGLENPHR; |
| 7353. | RKHVGLENPHR; |
| 7354. | HKHVGLENPHR; |
| 7355. | KRHVGLENPHR; |
| 7356. | RRHVGLENPHR; |
| 7357. | HRHVGLENPHR; |
| 7358. | KHKVGLENPHR; |
| 7359. | RHKVGLENPHR; |
| 7360. | HHKVGLENPHR; |
| 7361. | KKKVGLENPHR; |
| 7362. | RKKVGLENPHR; |
| 7363. | HKKVGLENPHR; |
| 7364. | KRKVGLENPHR; |
| 7365. | RRKVGLENPHR; |
| 7366. | HRKVGLENPHR; |
| 7367. | KHRVGLENPHR; |
| 7368. | RHRVGLENPHR; |
| 7369. | HHRVGLENPHR; |
| 7370. | KKRVGLENPHR; |
| 7371. | RKRVGLENPHR; |
| 7372. | HKRVGLENPHR; |
| 7373. | KRRVGLENPHR; |
| 7374. | RRRVGLENPHR; |
| 7375. | HRRVGLENPHR; |
| 7376. | KHHLGIENPHR; |
| 7377. | RHHLGIENPHR; |
| 7378. | HHHLGIENPHR; |
| 7379. | KKHLGIENPHR; |
| 7380. | RKHLGIENPHR; |
| 7381. | HKHLGIENPHR; |

TABLE 7-continued

SEQ ID NO. shown to left of sequence(cont'd)

| SEQ ID NO. | Sequence |
|---|---|
| 7382. | KRHLGIENPHR; |
| 7383. | RRHLGIENPHR; |
| 7384. | HRHLGIENPHR; |
| 7385. | KHKLGIENPHR; |
| 7386. | RHKLGIENPHR; |
| 7387. | HHKLGIENPHR; |
| 7388. | KKKLGIENPHR; |
| 7389. | RKKLGIENPHR; |
| 7390. | HKKLGIENPHR; |
| 7391. | KRKLGIENPHR; |
| 7392. | RRKLGIENPHR; |
| 7393. | HRKLGIENPHR; |
| 7394. | KHRLGIENPHR; |
| 7395. | RHRLGIENPHR; |
| 7396. | HHRLGIENPHR; |
| 7397. | KKRLGIENPHR; |
| 7398. | RKRLGIENPHR; |
| 7399. | HKRLGIENPHR; |
| 7400. | KRRLGIENPHR; |
| 7401. | RRRLGIENPHR; |
| 7402. | HRRLGIENPHR; |
| 7403. | KHHIGIENPHR; |
| 7404. | RHHIGIENPHR; |
| 7405. | HHHIGIENPHR; |
| 7406. | KKHIGIENPHR; |
| 7407. | RKHIGIENPHR; |
| 7408. | HKHIGIENPHR; |
| 7409. | KRHIGIENPHR; |
| 7410. | RRHIGIENPHR; |
| 7411. | HRHIGIENPHR; |
| 7412. | KHKIGIENPHR; |
| 7413. | RHKIGIENPHR; |
| 7414. | HHKIGIENPHR; |
| 7415. | KKKIGIENPHR; |
| 7416. | RKKIGIENPHR; |
| 7417. | HKKIGIENPHR; |
| 7418. | KRKIGIENPHR; |
| 7419. | RKKIGIENPHR; |
| 7420. | HRKIGIENPHR; |
| 7421. | KHRIGIENPHR; |
| 7422. | RHRIGIENPHR; |
| 7423. | HHRIGIENPHR; |
| 7424. | KKRIGIENPHR; |
| 7425. | RKRIGIENPHR; |
| 7426. | HKRIGIENPHR; |
| 7427. | KRRIGIENPHR; |
| 7428. | RRRIGIENPHR; |
| 7429. | HRRIGIENPHR; |
| 7430. | KHHVGIENPHR; |
| 7431. | RHHVGIENPHR; |
| 7432. | HHHVGIENPHR; |
| 7433. | KKHVGIENPHR; |
| 7434. | RKHVGIENPHR; |
| 7435. | HKHVGIENPHR; |
| 7436. | KRHVGIENPHR; |
| 7437. | RRHVGIENPHR; |
| 7438. | HRHVGIENPHR; |
| 7439. | KHKVGIENPHR; |
| 7440. | RHKVGIENPHR; |
| 7441. | HHKVGIENPHR; |
| 7442. | KKKVGIENPHR; |
| 7443. | RKKVGIENPHR; |
| 7444. | HKKVGIENPHR; |
| 7445. | KRKVGIENPHR; |
| 7446. | RRKVGIENPHR; |
| 7447. | HRKVGIENPHR; |
| 7448. | KHRVGIENPHR; |
| 7449. | RHRVGIENPHR; |
| 7450. | HHRVGIENPHR; |
| 7451. | KKRVGIENPHR; |
| 7452. | RKRVGIENPHR; |
| 7453. | HKRVGIENPHR; |
| 7454. | KRRVGIENPHR; |
| 7455. | RRRVGIENPHR; |
| 7456. | HRRVGIENPHR; |
| 7457. | KHHLGVENPHR; |
| 7458. | RHHLGVENPHR; |
| 7459. | HHHLGVENPHR; |

TABLE 7-continued

SEQ ID NO. shown to left of sequence(cont'd)

| SEQ ID NO. | Sequence |
|---|---|
| 7460. | KKHLGVENPHR; |
| 7461. | RKHLGVENPHR; |
| 7462. | HKHLGVENPHR; |
| 7463. | KRHLGVENPHR; |
| 7464. | RRHLGVENPHR; |
| 7465. | HRHLGVENPHR; |
| 7466. | KHKLGVENPHR; |
| 7467. | RHKLGVENPHR; |
| 7468. | HHKLGVENPHR; |
| 7469. | KKKLGVENPHR; |
| 7470. | RKKLGVENPHR; |
| 7471. | HKKLGVENPHR; |
| 7472. | KRKLGVENPHR; |
| 7473. | RRKLGVENPHR; |
| 7474. | HRKLGVENPHR; |
| 7475. | KHRLGVENPHR; |
| 7476. | RHRLGVENPHR; |
| 7477. | HHRLGVENPHR; |
| 7478. | KKRLGVENPHR; |
| 7479. | RKRLGVENPHR; |
| 7480. | HKRLGVENPHR; |
| 7481. | KRRLGVENPHR; |
| 7482. | RRRLGVENPHR; |
| 7483. | HRRLGVENPHR; |
| 7484. | KHHIGVENPHR; |
| 7485. | RHHIGVEEPHR; |
| 7486. | HHHIGVENPHR; |
| 7487. | KKHIGVENPHR; |
| 7488. | RKHIGVENPHR; |
| 7489. | HKHIGVENPHR; |
| 7490. | KRHIGVENPHR; |
| 7491. | RRHIGVENPHR; |
| 7492. | HRHIGVENPHR; |
| 7493. | KHKIGVENPHR; |
| 7494. | RHKIGVENPHR; |
| 7495. | HHKIGVENPHR; |
| 7496. | KKKIGVENPHR; |
| 7497. | RKKVGVENPHR; |
| 7498. | HKKIGVENPHR; |
| 7499. | KRKIGVENPHR; |
| 7500. | RRKIGVENPHR; |
| 7501. | HRKIGVENPHR; |
| 7502. | KHRIGVENPHR; |
| 7503. | RHRIGVENPHR; |
| 7504. | HHRIGVENPHR; |
| 7505. | KKRIGVENPHR; |
| 7506. | RKRIGVENPHR; |
| 7507. | HKRIGVENPHR; |
| 7508. | KRRIGVENPHR; |
| 7509. | RRRIGVENPHR; |
| 7510. | HRRIGVENPHR; |
| 7511. | KHHVGVENPHR; |
| 7512. | RHHVGVENPHR; |
| 7513. | HHHVGVENPHR; |
| 7514. | KKHVGVENPHR; |
| 7515. | RKHVGVENPHR; |
| 7516. | HKHVGVENPHR; |
| 7517. | KRHVGVENPHR; |
| 7518. | RRHVGVENPHR; |
| 7519. | HRHVGVENPHR; |
| 7520. | KHKVGVENPHR; |
| 7521. | RHKVGVENPHR; |
| 7522. | HHKVGVENPHR; |
| 7523. | KKKVGVENPHR; |
| 7524. | RKKVGVENPHR; |
| 7525. | HKKVGVENPHR; |
| 7526. | KRKVGVENPHR; |
| 7527. | RRKVGVEEPHR; |
| 7528. | HRKVGVENPHR; |
| 7529. | KHRVGVENPHR; |
| 7530. | RHRVGVENPHR; |
| 7531. | HHRVGVENPHR; |
| 7532. | KKRVGVENPHR; |
| 7533. | RKRVGVENPHR; |
| 7534. | HKRVGVENPHR; |
| 7535. | KRRVGVENPHR; |
| 7536. | RRRVGVENPHR; |
| 7537. | HRRVGVENPHR; |

TABLE 7-continued

SEQ ID NO. shown to left of sequence(cont'd)

| SEQ ID NO. | Sequence |
|---|---|
| 7538. | KHHLGLNNPHR; |
| 7539. | RHHLGLNNPHR; |
| 7540. | HHHLGLNNPHR; |
| 7541. | KKHLGLNNPHR; |
| 7542. | RKHLGLNNPHR; |
| 7543. | HKHLGLNNPHR; |
| 7544. | KRHLGLNNPHR; |
| 7545. | RRHLGLNNPHR; |
| 7546. | HRHLGLNNPHR; |
| 7547. | KHKLGLNNPHR; |
| 7548. | RHKLGLNNPHR; |
| 7549. | HHKLGLNNPHR; |
| 7550. | KKKLGLNNPHR; |
| 7551. | RKKLGLNNPHR; |
| 7552. | HKKLGLNNPHR; |
| 7553. | KRKLGLNNPHR; |
| 7554. | RRKLGLNNPHR; |
| 7555. | HRKLGLNNPHR; |
| 7556. | KHRLGLNNPHR; |
| 7557. | RHRLGLNNPHR; |
| 7558. | HHRLGLNNPHR; |
| 7559. | KKRLGLNNPHR; |
| 7560. | RKRLGLNNPHR; |
| 7561. | HKRLGLNNPHR; |
| 7562. | KRRLGLNNPHR; |
| 7563. | RRRLGLNNPHR; |
| 7564. | HRRLGLNNPHR; |
| 7565. | KHHIGLNNPHR; |
| 7566. | RHHIGLNNPHR; |
| 7567. | HHHIGLNNPHR; |
| 7568. | KKHIGLNNPHR; |
| 7569. | RKHIGLNNPHR; |
| 7570. | HKHIGLNNPHR; |
| 7571. | KRHIGLNNPHR; |
| 7572. | RRHIGLNNPHR; |
| 7573. | HRHIGLNNPHR; |
| 7574. | KHKIGLNNPHR; |
| 7575. | RHKIGLNNPHR; |
| 7576. | HHKIGLNNPHR; |
| 7577. | KKKIGLNNPHR; |
| 7578. | RKKIGLNNPHR; |
| 7579. | HKKIGLNNPHR; |
| 7580. | KRKIGLNNPHR; |
| 7581. | RRKIGLNNPHR; |
| 7582. | HRKIGLNNPHR; |
| 7583. | KHRIGLNNPHR; |
| 7584. | RHRIGLNNPHR; |
| 7585. | HHRIGLNNPHR; |
| 7586. | KKRIGLNNPHR; |
| 7587. | RKRIGLNNPHR; |
| 7588. | HKRIGLNNPHR; |
| 7589. | KRRIGLNNPHR; |
| 7590. | RRRIGLNNPHR; |
| 7591. | HRRIGLNNPHR; |
| 7592. | KHHVGLNNPHR; |
| 7593. | RHHVGLNNPHR; |
| 7594. | HHHVGLNNPHR; |
| 7595. | KKHVGLNNPHR; |
| 7596. | RKHVGLNNPHR; |
| 7597. | HKHVGLNNPHR; |
| 7598. | KRHVGLNNPHR; |
| 7599. | RRHVGLNNPHR; |
| 7600. | HRHVGLNNPHR; |
| 7601. | KHKVGLNNPHR; |
| 7602. | RHKVGLNNPHR; |
| 7603. | HHKVGLNNPHR; |
| 7604. | KKKVGLNNPHR; |
| 7605. | RKKVGLNNPHR; |
| 7606. | HKKVGLNNPHR; |
| 7607. | KRKVGLNNPHR; |
| 7608. | RRKVGLNNPHR; |
| 7609. | HRKVGLNNPHR; |
| 7610. | KHRVGLNNPHR; |
| 7611. | RHRVGLNNPHR; |
| 7612. | HHRVGLNNPHR; |
| 7613. | KKRVGLNNPHR; |
| 7614. | RKRVGLNNPHR; |
| 7615. | HKRVGLNNPHR; |

TABLE 7-continued

SEQ ID NO. shown to left of sequence(cont'd)

| | |
|---|---|
| 7616. | KRRVGLNNPHR; |
| 7617. | RRRVGLNNPHR; |
| 7618. | HRRVGLNNPHR; |
| 7619. | KHHLGINNPHR; |
| 7620. | RHHLGINNPHR; |
| 7621. | HHHLGINNPHR; |
| 7622. | KKHLGINNPHR; |
| 7623. | RKHLGINNPHR; |
| 7624. | HKHLGINNPHR; |
| 7625. | KRHLGINNPHR; |
| 7626. | RRHLGINNPHR; |
| 7627. | HRHLGINNPHR; |
| 7628. | KHKLGINNPHR; |
| 7629. | RHKLGINNPHR; |
| 7630. | HHKLGINNPHR; |
| 7631. | KKKLGINNPHR; |
| 7632. | RKKLGINNPHR; |
| 7633. | HKKLGINNPHR; |
| 7634. | KRKLGINNPHR; |
| 7635. | RRKLGINNPHR; |
| 7636. | HRKLGINNPHR; |
| 7637. | KHRLGINNPHR; |
| 7638. | RHRLGINNPHR; |
| 7639. | HHRLGINNPHR; |
| 7640. | KKRLGINNPHR; |
| 7641. | RKRLGINNPHR; |
| 7642. | HKRLGINNPHR; |
| 7643. | KRRLGINNPHR; |
| 7644. | RRRLGINNPHR; |
| 7645. | HRRLGINNPHR; |
| 7646. | KHHIGIENPHR; |
| 7647. | RHHIGINNPHR; |
| 7648. | HHHIGINNPHR; |
| 7649. | KKHIGINNPHR; |
| 7650. | RKHIGINNPHR; |
| 7651. | HKHIGINNPHR; |
| 7652. | KRHIGINNPHR; |
| 7653. | RRHIGVNNPHR; |
| 7654. | HRHIGINNPHR; |
| 7655. | KHKIGINNPHR; |
| 7656. | RHKIGINNPHR; |
| 7657. | HHKIGINNPHR; |
| 7658. | KKKIGINNPHR; |
| 7659. | RKKIGINNPHR; |
| 7660. | HKKIGINNPHR; |
| 7661. | KRKIGINNPHR; |
| 7662. | RRKIGINNPHR; |
| 7663. | HRKIGVNNPHR; |
| 7664. | KHRIGINNPHR; |
| 7665. | RHRIGINNPHR; |
| 7666. | HHRIGINNPHR; |
| 7667. | KKRIGINNPHR; |
| 7668. | RKRIGINNPHR; |
| 7669. | HKRIGINNPHR; |
| 7670. | KRRIGINNPHR; |
| 7671. | RRRIGINNPHR; |
| 7672. | HRRIGINNPHR; |
| 7673. | KHHVGINNPHR; |
| 7674. | RHHVGINNPHR; |
| 7675. | HHHVGINNPHR; |
| 7676. | KKHVGINNPHR; |
| 7677. | RKHVGINNPHR; |
| 7678. | HKHVGINNPHR; |
| 7679. | KRHVGINNPHR; |
| 7680. | RRHVGINNPHR; |
| 7681. | HRHVGINNPHR; |
| 7682. | KHKVGINNPHR; |
| 7683. | RHKVGINNPHR; |
| 7684. | HHKVGINNPHR; |
| 7685. | KKKVGINNPHR; |
| 7686. | RKKVGINNPHR; |
| 7687. | HKKVGINNPHR; |
| 7688. | KRKVGINNPHR; |
| 7689. | RRKVGINNPHR; |
| 7690. | HRKVGINNPHR; |
| 7691. | KHRVGINNPHR; |
| 7692. | RHRVGINNPHR; |
| 7693. | HHRVGINNPHR; |

TABLE 7-continued

SEQ ID NO. shown to left of sequence(cont'd)

| | |
|---|---|
| 7694. | KKRVGINNPHR; |
| 7695. | RKRVGINNPHR; |
| 7696. | HKRVGINNPHR; |
| 7697. | KRRVGINNPHR; |
| 7698. | RRRVGINNPHR; |
| 7699. | HRHVGINNPHR; |
| 7700. | KHHLGVNNPHR; |
| 7701. | RHHLGVNNPHR; |
| 7702. | HHHLGVNNPHR; |
| 7703. | KKHLGVNNPHR; |
| 7704. | RKHLGVNNPHR; |
| 7705. | HKHLGVNNPHR; |
| 7706. | KRHLGVNNPHR; |
| 7707. | RRHLGVNNPHR; |
| 7708. | HRHLGVNNPHR; |
| 7709. | KHKLGVNNPHR; |
| 7710. | RHKLGVNNPHR; |
| 7711. | HHKLGVNNPHR; |
| 7712. | KKKLGVNNPHR; |
| 7713. | RKKLGVNNPHR; |
| 7714. | HKKLGVNNPHR; |
| 7715. | KRKLGVNNPHR; |
| 7716. | RRKLGVNNPHR; |
| 7717. | HRKLGVNNPHR; |
| 7718. | KHRLGVNNPHR; |
| 7719. | RHRLGVNNPHR; |
| 7720. | HHRLGVNNPHR; |
| 7721. | KKRLGVNNPHR; |
| 7722. | RKRLGVNNPHR; |
| 7723. | HKRLGVNNPHR; |
| 7724. | KRRLGVNNPHR; |
| 7725. | RRRLGVNNPHR; |
| 7726. | HRRLGVNNPHR; |
| 7727. | KHHIGVNNPHR; |
| 7728. | RHHIGVNNPHR; |
| 7729. | HHHIGVNNPHR; |
| 7730. | KKHIGVNNPHR; |
| 7731. | RKHIGVNNPHR; |
| 7732. | HKHIGVNNPHR; |
| 7733. | KRHIGVNNPHR; |
| 7734. | RRHIGVNNPHR; |
| 7735. | HRHIGVNNPHR; |
| 7736. | KHKIGVNNPHR; |
| 7737. | RHKIGVNNPHR; |
| 7738. | HHKIGVNNPHR; |
| 7739. | KKKIGVNNPHR; |
| 7740. | RKKIGVNNPHR; |
| 7741. | HKKIGVNNPHR; |
| 7742. | KRKIGVNNPHR; |
| 7743. | RRHIGVNNPHR; |
| 7744. | HRKIGVNNPHR; |
| 7745. | KHRIGVNNPHR; |
| 7746. | RHRIGVNNPHR; |
| 7747. | HHRIGVNNPHR; |
| 7748. | KKRIGVNNPHR; |
| 7749. | RKRIGVNNPHR; |
| 7750. | HKRIGVNNPHR; |
| 7751. | KRRIGVNNPHR; |
| 7752. | RRRIGVNNPHR; |
| 7753. | HRRIGVNNPHR; |
| 7754. | KHHVGVNNPHR; |
| 7755. | RHHVGVNNPHR; |
| 7756. | HHHVGVNNPHR; |
| 7757. | KKHVGVNNPHR; |
| 7758. | RKHVGVNNPHR; |
| 7759. | HKHVGVNNPHR; |
| 7760. | KRHVGVNNPHR; |
| 7761. | RRHVGVNNPHR; |
| 7762. | HRHVGVNNPHR; |
| 7763. | KHKVGVNNPHR; |
| 7764. | RHKVGVNNPHR; |
| 7765. | HHKVGVNNPHR; |
| 7766. | KKKVGVNNPHR; |
| 7767. | RKKVGVNNPHR; |
| 7768. | HKKVGVNNPHR; |
| 7769. | KRKVGVNNPHR; |
| 7770. | RRKVGVNNPHR; |
| 7771. | HRKVGVNNPHR; |

TABLE 7-continued

SEQ ID NO. shown to left of sequence(cont'd)

| SEQ ID | Sequence |
|---|---|
| 7772. | KHRVGVNNPHR; |
| 7773. | RHRVGVNNPHR; |
| 7774. | HHRVGVNNPHR; |
| 7775. | KKRVGVNNPHR; |
| 7776. | RKRVGVNNPHR; |
| 7777. | HKRVGVNNPHR; |
| 7778. | KRRVGVNNPHR; |
| 7779. | RRRVGVNNPHR; |
| 7780. | HRRVGVNNPHR; |
| 7781. | KHHLGLEEPHH; |
| 7782. | RHHLGLEEPHH; |
| 7783. | HHHLGLEEPHH; |
| 7784. | KKHLGLEEPHH; |
| 7785. | RKHLGLEEPHH; |
| 7786. | HKHLGLEEPHH; |
| 7787. | KRHLGLEEPHH; |
| 7788. | RRHLGLEEPHH; |
| 7789. | HRHLGLEEPHH; |
| 7790. | KHKLGLEEPHH; |
| 7791. | RHKLGLEEPHH; |
| 7792. | HHKLGLEEPHH; |
| 7793. | KKKLGLEEPHH; |
| 7794. | RKKLGLEEPHH; |
| 7795. | HKKLGLEEPHH; |
| 7796. | KRKLGLEEPHH; |
| 7797. | RRHLGLEEPHH; |
| 7798. | HRKLGLEEPHH; |
| 7799. | KHRLGLEEPHH; |
| 7800. | RHRLGLEEPHH; |
| 7801. | HHRLGLEEPHH; |
| 7802. | KKRLGLEEPHH; |
| 7803. | RKRLGLEEPHH; |
| 7804. | HKRLGLEEPHH; |
| 7805. | KRRLGLEEPHH; |
| 7806. | RRRLGLEEPHH; |
| 7807. | HRRLGLEEPHH; |
| 7808. | KHHIGLEEPHH; |
| 7809. | RHHIGLEEPHH; |
| 7810. | HHHIGLEEPHH; |
| 7811. | KKHIGLEEPHH; |
| 7812. | RKHIGLEEPHH; |
| 7813. | HKHIGLEEPHH; |
| 7814. | KRHIGLEEPHH; |
| 7815. | RRHIGLEEPHH; |
| 7816. | HRHIGLEEPHH; |
| 7817. | KHKIGLEEPHH; |
| 7818. | RHKIGLEEPHH; |
| 7819. | HHKIGLEEPHH; |
| 7820. | KKKIGLEEPHH; |
| 7821. | RKKIGLEEPHH; |
| 7822. | HKKIGLEEPHH; |
| 7823. | KRKIGLEEPHH; |
| 7824. | RRKIGLEEPHH; |
| 7825. | HRKIGLEEPHH; |
| 7826. | KHRIGLEEPHH; |
| 7827. | RHRIGLEEPHH; |
| 7828. | HHRIGLEEPHH; |
| 7829. | KKRIGLEEPHH; |
| 7830. | RKRIGLEEPHH; |
| 7831. | HKRIGLEEPHH; |
| 7832. | KRRIGLEEPHH; |
| 7833. | RRRIGLEEPHH; |
| 7834. | HRHIGLEEPHH; |
| 7835. | KHHVGLEEPHH; |
| 7836. | RHHVGLEEPHH; |
| 7837. | HHHVGLEEPHH; |
| 7838. | KKHVGLEEPHH; |
| 7839. | RKHVGLEEPHH; |
| 7840. | HKHVGLEEPHH; |
| 7841. | KRHVGLEEPHH; |
| 7842. | RRHVGLEEPHH; |
| 7843. | HRHVGLEEPHH; |
| 7844. | KHKVGLEEPHH; |
| 7845. | RHKVGLEEPHH; |
| 7846. | HHKVGLEEPHH; |
| 7847. | KKKVGLEEPHH; |
| 7848. | RKKVGLEEPHH; |
| 7849. | HKKVGLEEPHH; |

TABLE 7-continued

SEQ ID NO. shown to left of sequence(cont'd)

| SEQ ID NO. | Sequence |
|---|---|
| 7850. | KRKVGLEEPHH; |
| 7851. | RRKVGLEEPHH; |
| 7852. | HRKVGLEEPHH; |
| 7853. | KHRVGLEEPHH; |
| 7854. | RHRVGLEEPHH; |
| 7855. | HHRVGLEEPHH; |
| 7856. | KKRVGLEEPHH; |
| 7857. | RKRVGLEEPHH; |
| 7858. | HKRVGLEEPHH; |
| 7859. | KRRVGLEEPHH; |
| 7860. | RRRVGLEEPHH; |
| 7861. | HRRVGLEEPHH; |
| 7862. | KHHLGIEEPHH; |
| 7863. | RHHLGIEEPHH; |
| 7864. | HHHLGIEEPHH; |
| 7865. | KKHLGIEEPHH; |
| 7866. | RKHLGIEEPHH; |
| 7867. | HKHLGIEEPHH; |
| 7868. | KRHLGIEEPHH; |
| 7869. | RRHLGIEEPHH; |
| 7870. | HRHLGIEEPHH; |
| 7871. | KHKLGIEEPHH; |
| 7872. | RHKLGIEEPHH; |
| 7873. | HHKLGIEEPHH; |
| 7874. | KKKLGIEEPHH; |
| 7875. | RKKLGIEEPHH; |
| 7876. | HKKLGIEEPHH; |
| 7877. | KRKLGIEEPHH; |
| 7878. | RRKLGIEEPHH; |
| 7879. | HRKLGIEEPHH; |
| 7880. | KHRLGIEEPHH; |
| 7881. | RHRLGIEEPHH; |
| 7882. | HHRLGIEEPHH; |
| 7883. | KKRLGIEEPHH; |
| 7884. | RKRLGIEEPHH; |
| 7885. | HKRLGIEEPHH; |
| 7886. | KRRLGIEEPHH; |
| 7887. | RRRLGIEEPHH; |
| 7888. | HRRLGIEEPHH; |
| 7889. | KHHIGIEEPHH; |
| 7890. | RHHIGIEEPHH; |
| 7891. | HHHIGIEEPHH; |
| 7892. | KKHIGIEEPHH; |
| 7893. | RKHIGIEEPHH; |
| 7894. | HKHIGIEEPHH; |
| 7895. | KRHIGIEEPHH; |
| 7896. | RRHIGIEEPHH; |
| 7897. | HRHIGIEEPHH; |
| 7898. | KHKIGIEEPHH; |
| 7899. | RHKIGIEEPHH; |
| 7900. | HHKIGIEEPHH; |
| 7901. | KKKIGIEEPHH; |
| 7902. | RKKIGIEEPHH; |
| 7903. | HKKIGIEEPHH; |
| 7904. | KRKIGIEEPHH; |
| 7905. | RRKIGIEEPHH; |
| 7906. | HRKIGIEEPHH; |
| 7907. | KHRIGIEEPHH; |
| 7908. | RHRIGIEEPHH; |
| 7909. | HHRIGIEEPHH; |
| 7910. | KKRIGIEEPHH; |
| 7911. | RKKIGIEEPHH; |
| 7912. | HKRIGIEEPHH; |
| 7913. | KRRIGIEEPHH; |
| 7914. | RRRIGIEEPHH; |
| 7915. | HRRIGIEEPHH; |
| 7916. | KHHVGIEEPHH; |
| 7917. | RHHVGIEEPHH; |
| 7918. | HHHVGIEEPHH; |
| 7919. | KKHVGIEEPHH; |
| 7920. | RKHVGIEEPHH; |
| 7921. | HKHVGIEEPHH; |
| 7922. | KRHVGIEEPHH; |
| 7923. | RRHVGIEEPHH; |
| 7924. | HRHVGIEEPHH; |
| 7925. | KHKVGIEEPHH; |
| 7926. | RHKVGIEEPHH; |
| 7927. | HHKVGIEEPHH; |

TABLE 7-continued

SEQ ID NO. shown to left of sequence(cont'd)

| SEQ ID NO. | Sequence |
|---|---|
| 7928. | KKKVGIEEPHH; |
| 7929. | RKKVGIEEPHH; |
| 7930. | HKKVGIEEPHH; |
| 7931. | KRKVGIEEPHH; |
| 7932. | RRKVGIEEPHH; |
| 7933. | HRKVGIEEPHH; |
| 7934. | KHRVGIEEPHH; |
| 7935. | RHRVGIEEPHH; |
| 7936. | HHRVGIEEPHH; |
| 7937. | KKRVGIEEPHH; |
| 7938. | RKRVGIEEPHH; |
| 7939. | HKRVGIEEPHH; |
| 7940. | KRRVGIEEPHH; |
| 7941. | RRRVGIEEPHH; |
| 7942. | HRRVGIEEPHH; |
| 7943. | KHHLGVEEPHH; |
| 7944. | RHHLGVEEPHH; |
| 7945. | HHRLGVEEPHH; |
| 7946. | KKHLGVEEPHH; |
| 7947. | RKKLGVEEPHH; |
| 7948. | HKHLGVEEPHH; |
| 7949. | KRHLGVEEPHH; |
| 7950. | RRHLGVEEPHH; |
| 7951. | HRHLGVEEPHH; |
| 7952. | KHKLGVEEPHH; |
| 7953. | RHKLGVEEPHH; |
| 7954. | HHKLGVEEPHH; |
| 7955. | KKKLGVEEPHH; |
| 7956. | RKKLGVEEPHH; |
| 7957. | HKKLGVEEPHH; |
| 7958. | KRKLGVEEPHH; |
| 7959. | RRKLGVEEPHH; |
| 7960. | HRKLGVEEPHH; |
| 7961. | KHRLGVEEPHH; |
| 7962. | RHRLGVEEPHH; |
| 7963. | HHRLGVEEPHH; |
| 7964. | KKRLGVEEPHH; |
| 7965. | RKRLGVEEPHH; |
| 7966. | HKRLGVEEPHH; |
| 7967. | KRRLGVEEPHH; |
| 7968. | RRRLGVEEPHH; |
| 7969. | HRRLGVEEPHH; |
| 7970. | KHHIGVEEPHH; |
| 7971. | RHHIGVEEPHH; |
| 7972. | HHHIGVEEPHH; |
| 7973. | KKHIGVEEPHH; |
| 7974. | RKHIGVEEPHH; |
| 7975. | HKHIGVEEPHH; |
| 7976. | KRHIGVEEPHH; |
| 7977. | RRHIGVEEPHH; |
| 7978. | HRHIGVEEPHH; |
| 7979. | KHKIGVEEPHH; |
| 7980. | RHKIGVEEPHH; |
| 7981. | HHKIGVEEPHH; |
| 7982. | KKKIGVEEPHH; |
| 7983. | RKKIGVEEPHH; |
| 7984. | HKKIGVEEPHH; |
| 7985. | KRKIGVEEPHH; |
| 7986. | RRKIGVEEPHH; |
| 7987. | HRKIGVEEPHH; |
| 7988. | KHRIGVEEPHH; |
| 7989. | RHRIGVEEPHH; |
| 7990. | HHRIGVEEPHH; |
| 7991. | KKRIGVEEPHH; |
| 7992. | RKRIGVEEPHH; |
| 7993. | HKRIGVEEPHH; |
| 7994. | KRRIGVEEPHH; |
| 7995. | RRRIGVEEPHH; |
| 7996. | HRRIGVEEPHH; |
| 7997. | KHHVGVEEPHH; |
| 7998. | RHHVGVEEPHH; |
| 7999. | HHHVGVEEPHH; |
| 8000. | KKHVGVEEPHH; |
| 8001. | RKKVGVEEPHH; |
| 8002. | HKHVGVEEPHH; |
| 8003. | KRHVGVEEPHH; |
| 8004. | RRHVGVEEPHH; |
| 8005. | HRHVGVEEPHH; |

TABLE 7-continued

SEQ ID NO. shown to left of sequence(cont'd)

| SEQ ID | Sequence |
|---|---|
| 8006. | KHKVGVEEPHH; |
| 8007. | RHKVGVEEPHH; |
| 8008. | HHKVGVEEPHH; |
| 8009. | KKKVGVEEPHH; |
| 8010. | RKKVGVEEPHH; |
| 8011. | HKKVGVEEPHH; |
| 8012. | KRKVGVEEPHH; |
| 8013. | RRKVGVEEPHH; |
| 8014. | HRKVGVEEPHH; |
| 8015. | KHRVGVEEPHH; |
| 8016. | RHRVGVEEPHH; |
| 8017. | HHRVGVEEPHH; |
| 8018. | KKRVGVEEPHH; |
| 8019. | RKRVGVEEPHH; |
| 8020. | HKRVGVEEPHH; |
| 8021. | KRRVGVEEPHH; |
| 8022. | RRRVGVEEPHH; |
| 8023. | HRRVGVEEPHH; |
| 8024. | KHHLGLNEPHH; |
| 8025. | RHHLGLNEPHH; |
| 8026. | HHHLGLNEPHH; |
| 8027. | KKHLGLNEPHH; |
| 8028. | RKHLGLNEPHH; |
| 8029. | HKHLGLNEPHH; |
| 8030. | KRHLGLNEPHH; |
| 8031. | RRHLGLNEPHH; |
| 8032. | HRHLGLNEPHH; |
| 8033. | KHKLGLNEPHH; |
| 8034. | RHKLGLNEPHH; |
| 8035. | HHKLGLNEPHH; |
| 8036. | KKKLGLNEPHH; |
| 8037. | RKKLGLNEPHH; |
| 8038. | HKKLGLNEPHH; |
| 8039. | KRKLGLNEPHH; |
| 8040. | RRKLGLNEPHH; |
| 8041. | HRKLGLNEPHH; |
| 8042. | KHRLGLNEPHH; |
| 8043. | RHRLGLNEPHH; |
| 8044. | HHRLGLNEPHH; |
| 8045. | KKRLGLNEPHH; |
| 8046. | RKRLGLNEPHH; |
| 8047. | HKRLGLNEPHH; |
| 8048. | KRRLGLNEPHH; |
| 8049. | RRRLGLNEPHH; |
| 8050. | HRRLGLNEPHH; |
| 8051. | KHHIGLNPHH; |
| 8052. | RHHLGLNEPHH; |
| 8053. | HHHIGLNEPHH; |
| 8054. | KKHIGLNEPHH; |
| 8055. | RKHIGLNEPHH; |
| 8056. | HKHIGLNEPHH; |
| 8057. | KRHIGLNEPHH; |
| 8058. | RRHIGLNEPHH; |
| 8059. | HRHIGLNEPHH; |
| 8060. | KHKLGLNEPHH; |
| 8061. | RHKIGLNEPHH; |
| 8062. | HHKIGLNEPHH; |
| 8063. | KKKIGLNEPHH; |
| 8064. | RKKIGLNEPHH; |
| 8065. | HKKIGLNEPHH; |
| 8066. | KRKIGLNEPHH; |
| 8067. | RRKIGLNEPHH; |
| 8068. | HRKIGLNEPHH; |
| 8069. | KHRIGLNEPHH; |
| 8070. | RHRIGLNEPHH; |
| 8071. | HHRIGLNEPHH; |
| 8072. | KKRIGLNEPHH; |
| 8073. | RKRIGLNEPHH; |
| 8074. | HKRIGLNEPHH; |
| 8075. | KRRIGLNEPHH; |
| 8076. | RRRIGLNEPHH; |
| 8077. | HRRIGLNEPHH; |
| 8078. | KHHVGLNEPHH; |
| 8079. | RHHVGLNEPHH; |
| 8080. | HHHVGLNEPHH; |
| 8081. | KKHVGLNEPHH; |
| 8082. | RKHVGLNEPHH; |
| 8083. | HKHVGLNEPHH; |

TABLE 7-continued

SEQ ID NO. shown to left of sequence(cont'd)

| | |
|---|---|
| 8084. | KRHVGLNEPHH; |
| 8085. | RRHVGLNEPHH; |
| 8086. | HRHVGLNEPHH; |
| 8087. | KHKVGLNEPHH; |
| 8088. | RHKVGLNEPHH; |
| 8089. | HHKVGLNEPHH; |
| 8090. | KKKVGLNEPHH; |
| 8091. | RKKVGLNEPHH; |
| 8092. | HKKVGLNEPHH; |
| 8093. | KRKVGLNEPHH; |
| 8094. | RRKVGLNEPHH; |
| 8095. | HRKVGLNEPHH; |
| 8096. | KHRVGLNEPHH; |
| 8097. | RHRVGLNEPHH; |
| 8098. | HHRVGLNEPHH; |
| 8099. | KKRVGLNEPHH; |
| 8100. | RKRVGLNEPHH; |
| 8101. | HKRVGLNEPHH; |
| 8102. | KRRVGLNEPHH; |
| 8103. | RRRVGLNEPHH; |
| 8104. | HRRVGLNEPHH; |
| 8105. | KHHLGINEPHH; |
| 8106. | RHHLGINEPHH; |
| 8107. | HHHLGINEPHH; |
| 8108. | KKHLGVNEPHH; |
| 8109. | RKHLGINEPHH; |
| 8110. | HKHLGINEPHH; |
| 8111. | KRHLGINEPHH; |
| 8112. | RRHLGINEPHH; |
| 8113. | HRHLGINEPHH; |
| 8114. | KHKLGINEPHH; |
| 8115. | RHKLGINEPHH; |
| 8116. | HHKLGINEPHH; |
| 8117. | KKKLGINEPHH; |
| 8118. | RKKLGINEPHH; |
| 8119. | HKKLGINEPHH; |
| 8120. | KRKLGINEPHH; |
| 8121. | RHKLGINEPHH; |
| 8122. | HRKLGINEPHH; |

TABLE 7-continued

SEQ ID NO. shown to left of sequence(cont'd)

| | |
|---|---|
| 8123. | KHRLGINEPHH; |
| 8124. | RHRLGINEPHH; |
| 8125. | HHRLGINEPHH; |
| 8126. | KKRLGINEPHH; |
| 8127. | RKRLGINEPHH; |
| 8128. | HKRLGINEPHH; |
| 8129. | KRRLGINEPHH; |
| 8130. | RRRLGINEPHH; |
| 8131. | HRRLGINEPHH; |
| 8132. | KHHIGIENPHH; |
| 8133. | RHHIGINEPHH; |
| 8134. | HHHIGINEPHH; |
| 8135. | KKHIGINEPHH; |
| 8136. | RKHIGINEPHH; |
| 8137. | HKHIGINEPHH; |
| 8138. | KRHIGINEPHH; |
| 8139. | RRHIGINEPHH; |
| 8140. | HRHIGINEPHH; |
| 8141. | KHKIGINEPHH; |
| 8142. | RHKIGINEPHH; |
| 8143. | HHKIGINEPHH; |
| 8144. | KKKIGINEPHH; |
| 8145. | RKKIGINEPHH; |
| 8146. | HKKIGINEPHH; |
| 8147. | KRKIGINEPHH; |
| 8148. | RRKIGINEPHH; |
| 8149. | HRKIGINEPHH; |
| 8150. | KHRIGINEPHH; |
| 8151. | RHRIGINEPHH; |
| 8152. | HHRIGINEPHH; |
| 8153. | KKRIGINEPHH; |
| 8154. | RKRIGINEPHH; |
| 8155. | HKRIGINEPHH; |
| 8156. | KRRIGINEPHH; |
| 8157. | RRRIGINEPHH; |
| 8158. | HRHIGINEPHH; |
| 8159. | KHHVGINEPHH; |
| 8160. | RHHVGINEPHH; |
| 8161. | HHHVGINEPHH; |

TABLE 7-continued

SEQ ID NO. shown to left of sequence(cont'd)

| | |
|---|---|
| 8162. | KKHVGINEPHH; |
| 8163. | RKHVGINEPHH; |
| 8164. | HKHVGINEPHH; |
| 8165. | KRHVGINEPHH; |
| 8166. | RRHVGINEPHH; |
| 8167. | HRHVGINEPHH; |
| 8168. | KHKVGINEPHH; |
| 8169. | RHKVGINEPHH; |
| 8170. | HHKVGINEPHH; |
| 8171. | KKKVGINEPHH; |
| 8172. | RKKVGINEPHH; |
| 8173. | HKKVGINEPHH; |
| 8174. | KRKVGINEPHH; |
| 8175. | RRKVGINEPHH; |
| 8176. | HRKVGINEPHH; |
| 8177. | KHRVGINEPHH; |
| 8178. | RHRVGINEPHH; |
| 8179. | HHRVGINEPHH; |
| 8180. | KKRVGINEPHH; |
| 8181. | RKRVGINEPHH; |
| 8182. | HKRVGINEPHH; |
| 8183. | KRRVGINEPHH; |
| 8184. | RRRVGINEPHH; |
| 8185. | HRRVGINEPHH; |
| 8186. | KHHLGVNEPHH; |
| 8187. | RHHLGVNEPHH; |
| 8188. | HHHLGVNEPHH; |
| 8189. | KKHLGVNEPHH; |
| 8190. | RKHLGVNEPHH; |
| 8191. | HKHLGVNEPHH; |
| 8192. | KRHLGVNEPHH; |
| 8193. | RRHLGVNEPHH; |
| 8194. | HRHLGVNEPHH; |
| 8195. | KHKLGVNEPHH; |
| 8196. | RHKLGVNEPHH; |
| 8197. | HHKLGVNEPHH; |
| 8198. | KKKLGVNEPHH; |
| 8199. | RKKLGVNEPHH; |
| 8200. | HKKLGVNEPHH; |
| 8201. | KRKLGVNEPHH; |
| 8202. | RRKLGVNEPHH; |
| 8203. | HRKLGVNEPHH; |
| 8204. | KHHLGVNEPHH; |
| 8205. | RHRLGVNEPHH; |
| 8206. | HHRLGVNEPHH; |
| 8207. | KKRLGVNEPHH; |
| 8208. | RKRLGVNEPHH; |
| 8209. | HKRLGVNEPHH; |
| 8210. | KRRLGVNEPHH; |
| 8211. | RRRLGVNEPHH; |
| 8212. | HRRLGVNEPHH; |
| 8213. | KHHIGVNEPHH; |
| 8214. | RHHIGVNEPHH; |
| 8215. | HHHIGVNEPHH; |
| 8216. | KKHIGVNEPHH; |
| 8217. | RKHIGVNEPHH; |
| 8218. | HKHIGVNEPHH; |
| 8219. | KRHIGVNEPHH; |
| 8220. | RRHIGVNEPHH; |
| 8221. | HRHIGVNEPHH; |
| 8222. | KHKIGVNEPHH; |
| 8223. | RHKIGVNEPHH; |
| 8224. | HHKIGVNEPHH; |
| 8225. | KKKIGVNEPHH; |
| 8226. | RKKIGVNEPHH; |
| 8227. | HKKIGVNEPHH; |
| 8228. | KRKIGVNEPHH; |
| 8229. | RRKIGVNEPHH; |
| 8230. | HRKIGVNEPHH; |
| 8231. | KHRIGVNEPHH; |
| 8232. | RHRIGVNEPHH; |
| 8233. | HHRIGVNEPHH; |
| 8234. | KKRIGVNEPHH; |
| 8235. | RKRIGVNEPHH; |
| 8236. | HKRIGVNEPHH; |
| 8237. | KRRIGVNEPHH; |
| 8238. | RRRIGVNEPHH; |
| 8239. | HRRIGVNEPHH; |

TABLE 7-continued

SEQ ID NO. shown to left of sequence(cont'd)

| SEQ ID NO. | Sequence |
|---|---|
| 8240. | KHHVGVNEPHH; |
| 8241. | RHHVGVNEPHH; |
| 8242. | HHHVGVNEPHH; |
| 8243. | KKHVGVNEPHH; |
| 8244. | RKHVGVNEPHH; |
| 8245. | HKHVGVNEPHH; |
| 8246. | KRHVGVNEPHH; |
| 8247. | RRHVGVNEPHH; |
| 8248. | HRHVGVNEPHH; |
| 8249. | KKKVGVNEPHH; |
| 8250. | RHKVGVNEPHH; |
| 8251. | HHKVGVNEPHH; |
| 8252. | KKKVGVNEPHH; |
| 8253. | RKKVGVNEPHH; |
| 8254. | HKKVGVNEPHH; |
| 8255. | KRKVGVNEPHH; |
| 8256. | RRKVGVNEPHH; |
| 8257. | HRKVGVNEPHH; |
| 8258. | KHRVGVNEPHH; |
| 8259. | RHRVGVNEPHH; |
| 8260. | HHRVGVNEPHH; |
| 8261. | KKRVGVNEPHH; |
| 8262. | RKRVGVNEPHH; |
| 8263. | HKRVGVNEPHH; |
| 8264. | KRRVGVNEPHH; |
| 8265. | RRRVGVNEPHH; |
| 8266. | HRRVGVNEPHH; |
| 8267. | KHHLGLENPHH; |
| 8268. | RHHLGLENPHH; |
| 8269. | HHHLGLENPHH; |
| 8270. | KKHLGLENPHH; |
| 8271. | RKHLGLENPHH; |
| 8272. | HKHLGLENPHH; |
| 8273. | KRHLGLENPHH; |
| 8274. | RRHLGLENPHH; |
| 8275. | HRHLGLENPHH; |
| 8276. | KHKLGLENPHH; |
| 8277. | RHKLGLENPHH; |
| 8278. | HHKLGLENPHH; |
| 8279. | KKKLGLENPHH; |
| 8280. | RKKLGLENPHH; |
| 8281. | HKKLGLENPHH; |
| 8282. | KRKLGLENPHH; |
| 8283. | RRKLGLENPHH; |
| 8284. | HRKLGLENPHH; |
| 8285. | KHRLGLENPHH; |
| 8286. | RHRLGLENPHH; |
| 8287. | HHRLGLENPHH; |
| 8288. | KKRLGLENPHH; |
| 8289. | RKRLGLENPHH; |
| 8290. | HKRLGLENPHH; |
| 8291. | KRRLGLENPHH; |
| 8292. | RRRLGLENPHH; |
| 8293. | HRRLGLENPHH; |
| 8294. | KHHIGLENPHH; |
| 8295. | RHHIGLENPHH; |
| 8296. | HHHIGLENPHH; |
| 8297. | KKHIGLENPHH; |
| 8298. | RKHIGLENPHH; |
| 8299. | HKHIGLENPHH; |
| 8300. | KRHIGLENPHH; |
| 8301. | RRHIGLENPHH; |
| 8302. | HRHIGLENPHH; |
| 8303. | KHKIGLENPHH; |
| 8304. | RHKIGLENPHH; |
| 8305. | HHKIGLENPHH; |
| 8306. | KKKIGLENPHH; |
| 8307. | RKKIGLENPHH; |
| 8308. | HKKIGLENPHH; |
| 8309. | KRKIGLENPHH; |
| 8310. | RRKIGLENPHH; |
| 8311. | HRKIGLENPHH; |
| 8312. | KHRIGLENPHH; |
| 8313. | RHRIGLENPHH; |
| 8314. | HHRIGLENPHH; |
| 8315. | KKRIGLENPHH; |
| 8316. | RKRIGLENPHH; |
| 8317. | HKRIGLENPHH; |

TABLE 7-continued

SEQ ID NO. shown to left of sequence(cont'd)

| | |
|---|---|
| 8318. | KRRIGLENPHH; |
| 8319. | RRRIGLENPHH; |
| 8320. | HRRIGLENPHH; |
| 8321. | KHHVGLENPHH; |
| 8322. | RHHVGLENPHH; |
| 8323. | HHHVGLENPHH; |
| 8324. | KKHVGLENPHH; |
| 8325. | RKHVGLENPHH; |
| 8326. | HKHVGLENPHH; |
| 8327. | KRHVGLENPHH; |
| 8328. | RRHVGLENPHH; |
| 8329. | HRHVGLENPHH; |
| 8330. | KHKVGLENPHH; |
| 8331. | RHKVGLENPHH; |
| 8332. | HHKVGLENPHH; |
| 8333. | KKKVGLENPHH; |
| 8334. | RKKVGLENPHH; |
| 8335. | HKKVGLENPHH; |
| 8336. | KRKVGLENPHH; |
| 8337. | RRKVGLENPHH; |
| 8338. | HRKVGLENPHH; |
| 8339. | KHRVGLENPHH; |
| 8340. | RHRVGLENPHH; |
| 8341. | HHRVGLENPHH; |
| 8342. | KKRVGLENPHH; |
| 8343. | RKRVGLENPHH; |
| 8344. | HKRVGLENPHH; |
| 8345. | KRRVGLENPHH; |
| 8346. | RRRVGLENPHH; |
| 8347. | HRRVGLENPHH; |
| 8348. | KHHLGIENPHH; |
| 8349. | RHHLGIENPHH; |
| 8350. | HHHLGIENPHH; |
| 8351. | KKHLGIENPHH; |
| 8352. | RKHLGIENPHH; |
| 8353. | HKHLGIENPHH; |
| 8354. | KRHLGIENPHH; |
| 8355. | RRHLGIENPHH; |
| 8356. | HRHLGIENPHH; |
| 8357. | KHKLGIENPHH; |
| 8358. | RHKLGIENPHH; |
| 8359. | HHKLGIENPHH; |
| 8360. | KKKLGIENPHH; |
| 8361. | RKKLGIENPHH; |
| 8362. | HKKLGIENPHH; |
| 8363. | KRKLGIENPHH; |
| 8364. | RRKLGIENPHH; |
| 8365. | HRKLGIENPHH; |
| 8366. | KHRLGIENPHH; |
| 8367. | RHRLGIENPHH; |
| 8368. | HHRLGIENPHH; |
| 8369. | KKRLGIENPHH; |
| 8370. | RKRLGIENPHH; |
| 8371. | HKRLGIENPHH; |
| 8372. | KRRLGIENPHH; |
| 8373. | RRRLGIENPHH; |
| 8374. | HRRLGIENPHH; |
| 8375. | KHHIGIENPHH; |
| 8376. | RHHIGIENPHH; |
| 8377. | HHHIGIENPHH; |
| 8378. | KKHIGIENPHH; |
| 8379. | RKHIGIENPHH; |
| 8380. | HKHIGIENPHH; |
| 8381. | KRHIGIENPHH; |
| 8382. | RRHIGIENPHH; |
| 8383. | HRHIGIENPHH; |
| 8384. | KHKIGIENPHH; |
| 8385. | RHKIGIENPHH; |
| 8386. | HHKIGIENPHH; |
| 8387. | KKKIGIENPHH; |
| 8388. | RKKIGIENPHH; |
| 8389. | HKKIGIENPHH; |
| 8390. | KRKIGIENPHH; |
| 8391. | RRKIGIENPHH; |
| 8392. | HRKIGIENPHH; |
| 8393. | KHRIGIENPHH; |
| 8394. | RHRIGIENPHH; |
| 8395. | HHRIGIENPHH; |

TABLE 7-continued

SEQ ID NO. shown to left of sequence (cont'd)

| | |
|---|---|
| 8396. | KKRIGIENPHH; |
| 8397. | RKRIGIENPHH; |
| 8398. | HKRIGIENPHH; |
| 8399. | KRRIGIENPHH; |
| 8400. | RRRIGIENPHH; |
| 8401. | HRRIGIENPHH; |
| 8402. | KHHVGIENPHH; |
| 8403. | RHHVGIENPHH; |
| 8404. | HHHVGIENPHH; |
| 8405. | KKHVGIENPHH; |
| 8406. | RKHVGIENPHH; |
| 8407. | HKHVGIENPHH; |
| 8408. | KRHVGIENPHH; |
| 8409. | RRHVGIENPHH; |
| 8410. | HRHVGIENPHH; |
| 8411. | KHKVGIENPHH; |
| 8412. | RHKVGIENPHH; |
| 8413. | HHKVGIENPHH; |
| 8414. | KKKVGIENPHH; |
| 8415. | RKKVGIENPHH; |
| 8416. | HKKVGIENPHH; |
| 8417. | KRKVGIENPHH; |
| 8418. | RRKVGIENPHH; |
| 8419. | HRKVGIENPHH; |
| 8420. | KHRVGIENPHH; |
| 8421. | RHRVGIENPHH; |
| 8422. | HHRVGIENPHH; |
| 8423. | KKRVGIENPHH; |
| 8424. | RKRVGIENPHH; |
| 8425. | HKRVGIENPHH; |
| 8426. | KRRVGIENPHH; |
| 8427. | RRRVGIENPHH; |
| 8428. | HRRVGIENPHH; |
| 8429. | KHHLGVENPHH; |
| 8430. | RHHLGVENPHH; |
| 8431. | HHHLGVENPHH; |
| 8432. | KKHLGVENPHH; |
| 8433. | RKHLGVENPHH; |
| 8434. | HKHLGVENPHH; |
| 8435. | KRHLGVENPHH; |
| 8436. | RRHLGVENPHH; |
| 8437. | HRHLGVENPHH; |
| 8438. | KHKLGVENPHH; |
| 8439. | RHKLGVENPHH; |
| 8440. | HHKLGVENPHH; |
| 8441. | KKKLGVENPHH; |
| 8442. | RKKLGVENPHH; |
| 8443. | HKKLGVENPHH; |
| 8444. | KRKLGVENPHH; |
| 8445. | RRKLGVENPHH; |
| 8446. | HRKLGVENPHH; |
| 8447. | KHRLGVENPHH; |
| 8448. | RHRLGVENPHH; |
| 8449. | HHRLGVENPHH; |
| 8450. | KKRLGVENPHH; |
| 8451. | RKRLGVENPHH; |
| 8452. | HKRLGVENPHH; |
| 8453. | KRRLGVENPHH; |
| 8454. | RRRLGVENPHH; |
| 8455. | HRRLGVENPHH; |
| 8456. | KHHIGVENPHH; |
| 8457. | RHHIGVEEPHH; |
| 8458. | HHHIGVENPHH; |
| 8459. | KKHIGVENPHH; |
| 8460. | RKHIGVENPHH; |
| 8461. | HKHIGVENPHH; |
| 8462. | KRHIGVENPHH; |
| 8463. | RRHIGVENPHH; |
| 8464. | HRHIGVENPHH; |
| 8465. | KHKIGVENPHH; |
| 8466. | RHKIGVENPHH; |
| 8467. | HHKIGVENPHH; |
| 8468. | KKKIGVENPHH; |
| 8469. | RKKIGVENPHH; |
| 8470. | HKKIGVENPHH; |
| 8471. | KRKIGVENPHH; |
| 8472. | RRKIGVENPHH; |
| 8473. | HRKIGVENPHH; |

TABLE 7-continued

SEQ ID NO. shown to left of sequence(cont'd)

| | |
|---|---|
| 8474. | KHRIGVENPHH; |
| 8475. | RHRIGVENPHH; |
| 8476. | HKRIGVENPHH; |
| 8477. | KKRIGVENPHH; |
| 8478. | RKRIGVENPHH; |
| 8479. | HKRIGVENPHH; |
| 8480. | KRRIGVENPHH; |
| 8481. | RRRIGVENPHH; |
| 8482. | HRRIGVENPHH; |
| 8483. | KHHVGVENPHH; |
| 8484. | RHHVGVENPHH; |
| 8485. | HHHVGVENPHH; |
| 8486. | KKHVGVENPHH; |
| 8487. | RKHVGVENPHH; |
| 8488. | HKHVGVENPHH; |
| 8489. | KRHVGVENPHH; |
| 8490. | RRHVGVENPHH; |
| 8491. | HRHVGVENPHH; |
| 8492. | KHKVGVENPHH; |
| 8493. | RHKVGVENPHH; |
| 8494. | HHKVGVENPHH; |
| 8495. | KKKVGVENPHH; |
| 8496. | RKKVGVENPHH; |
| 8497. | HKKVGVENPHH; |
| 8498. | KRKVGVENPHH; |
| 8499. | RRKVGVEEPHH; |
| 8500. | HRKVGVENPHH; |
| 8501. | KHRVGVENPHH; |
| 8501. | RHRVGVENPHH; |
| 8503. | HHRVGVENPHH; |
| 8504. | KKRVGVENPHH; |
| 8505. | RKRVGVENPHH; |
| 8506. | HKRVGVENPHH; |
| 8507. | KRRVGVENPHH; |
| 8508. | RRRVGVENPHH; |
| 8509. | HRRVGVENPHH; |
| 8510. | KHHLGLNNPHH; |
| 8511. | RHHLGLNNPHH; |
| 8512. | HHHLGLNNPHH; |

TABLE 7-continued

SEQ ID NO. shown to left of sequence(cont'd)

| | |
|---|---|
| 8513. | KKHLGLNNPHH; |
| 8514. | RKHLGLNNPHH; |
| 8515. | HKHLGLNNPHH; |
| 8516. | KRHLGLNNPHH; |
| 8517. | RRHLGLNNPHH; |
| 8518. | HRHLGLNNPHH; |
| 8519. | KHKLGLNNPHH; |
| 8520. | RHKLGLNNPHH; |
| 8521. | HHKLGLNNPHH; |
| 8522. | KKKLGLNNPHH; |
| 8523. | RKKLGLNNPHH; |
| 8524. | HKKLGLNNPHH; |
| 8525. | KRKLGLNNPHH; |
| 8526. | RRKLGLNNPHH; |
| 8527. | HRKLGLNNPHH; |
| 8528. | KHRLGLNNPHH; |
| 8529. | RHRLGLNNPHH; |
| 8530. | HHRLGLNNPHH; |
| 8531. | KKRLGLNNPHH; |
| 8532. | RKRLGLNNPHH; |
| 8533. | HKRLGLNNPHH; |
| 8534. | KRRLGLNNPHH; |
| 8535. | RRRLGLNNPHH; |
| 8536. | HRRLGLNNPHH; |
| 8537. | KHHIGLNNPHH; |
| 8538. | RHHIGLNNPHH; |
| 8539. | HHHIGLNNPHH; |
| 8540. | KKHIGLNNPHH; |
| 8541. | RKHIGLNNPHH; |
| 8542. | HKHIGLNNPHH; |
| 8543. | KRHIGLNNPHH; |
| 8544. | RRHIGLNNPHH; |
| 8545. | HRHIGLNNPHH; |
| 8546. | KHKIGLNNPHH; |
| 8547. | RHKIGLNNPHH; |
| 8548. | HHKIGLNNPHH; |
| 8549. | KKKIGLNNPHH; |
| 8550. | RKKIGLNNPHH; |
| 8551. | HKKIGLNNPHH; |

TABLE 7-continued

SEQ ID NO. shown to left of sequence(cont'd)

| SEQ ID NO. | Sequence |
|---|---|
| 8552. | KRKIGLNNPHH; |
| 8553. | RRKIGLNNPHH; |
| 8554. | HRKIGLNNPHH; |
| 8555. | KHRIGLNNPHH; |
| 8556. | RHRIGLNNPHH; |
| 8557. | HHRIGLNNPHH; |
| 8558. | KKRIGLNNPHH; |
| 8559. | RKRIGLNNPHH; |
| 8560. | HKRIGLNNPHH; |
| 8561. | KRRIGLNNPHH; |
| 8562. | RRRIGLNNPHH; |
| 8563. | HRRIGLNNPHH; |
| 8564. | KHHVGLNNPHH; |
| 8565. | RHHVGLNNPHH; |
| 8566. | HHHVGLNNPHH; |
| 8567. | KKHVGLNNPHH; |
| 8568. | RKHVGLNNPHH; |
| 8569. | HKHVGLNNPHH; |
| 8570. | KRHVGLNNPHH; |
| 8571. | RRHVGLNNPHH; |
| 8572. | HRHVGLNNPHH; |
| 8573. | KHKVGLNNPHH; |
| 8574. | RHKVGLNNPHH; |
| 8575. | HHKVGLNNPHH; |
| 8576. | KKKVGLNNPHH; |
| 8577. | RKKVGLNNPHH; |
| 8578. | HKKVGLNNPHH; |
| 8579. | KRKVGLNNPHH; |
| 8580. | RRKVGLNNPHH; |
| 8581. | HRKVGLNNPHH; |
| 8582. | KHRVGLNNPHH; |
| 8583. | RHRVGLNNPHH; |
| 8584. | HHRVGLNNPHH; |
| 8585. | KKRVGLNNPHH; |
| 8586. | RKRVGLNNPHH; |
| 8587. | HKRVGLNNPHH; |
| 8588. | KRRVGLNNPHH; |
| 8589. | RRRVGLNNPHH; |
| 8590. | HRRVGLNNPHH; |
| 8591. | KHHLGINNPHH; |
| 8592. | RHHLGINNPHH; |
| 8593. | HHHLGINNPHH; |
| 8594. | KKHLGINNPHH; |
| 8595. | RKHLGINNPHH; |
| 8596. | HKHLGINNPHH; |
| 8597. | KRHLGINNPHH; |
| 8598. | RRHLGINNPHH; |
| 8599. | HRHLGINNPHH; |
| 8600. | KHKLGINNPHH; |
| 8601. | RHKLGINNPHH; |
| 8602. | HHKLGINNPHH; |
| 8603. | KKKLGINNPHH; |
| 8604. | RKKLGINNPHH; |
| 8605. | HKKLGINNPHH; |
| 8606. | KRKLGINNPHH; |
| 8607. | RRKLGINNPHH; |
| 8608. | HRKLGINNPHH; |
| 8609. | KHRLGINNPHH; |
| 8610. | RHRLGINNPHH; |
| 8611. | HHRLGINNPHH; |
| 8612. | KKRLGINNPHH; |
| 8613. | RKRLGINNPHH; |
| 8614. | HKRLGINNPHH; |
| 8615. | KRRLGINNPHH; |
| 8616. | RRRLGINNPHH; |
| 8617. | HRRLGINNPHH; |
| 8618. | KHHIGIENPHH; |
| 8619. | RHHIGINNPHH; |
| 8620. | HHHIGINNPHH; |
| 8621. | KKHIGINNPHH; |
| 8622. | RKHIGINNPHH; |
| 8623. | HKHIGINNPHH; |
| 8624. | KRHIGINNPHH; |
| 8625. | RRHIGINNPHH; |
| 8626. | HRHIGINNPHH; |
| 8627. | KHKIGINNPHH; |
| 8628. | RHKIGINNPHH; |
| 8629. | HHKIGINNPHH; |

TABLE 7-continued

SEQ ID NO. shown to left of sequence (cont'd)

| SEQ ID NO. | Sequence |
|---|---|
| 8630. | KKKIGINNPHH; |
| 8631. | RKKIGINNPHH; |
| 8632. | HKKIGINNPHH; |
| 8633. | KRKIGINNPHH; |
| 8634. | RRKIGINNPHH; |
| 8635. | HRKIGINNPHH; |
| 8636. | KHRIGINNPHH; |
| 8637. | RHRIGINNPHH; |
| 8638. | HHRIGINNPHH; |
| 8639. | KKRIGINNPHH; |
| 8640. | RKRIGINNPHH; |
| 8641. | HHRIGINNPHH; |
| 8642. | KRRIGINNPHH; |
| 8643. | RRRIGINNPHH; |
| 8644. | HRRIGINNPHH; |
| 8645. | KHHVGINNPHH; |
| 8646. | RHHVGINNPHH; |
| 8647. | HHHVGINNPHH; |
| 8648. | KKHVGINNPHH; |
| 8649. | RKHVGINNPHH; |
| 8650. | HKHVGINNPHH; |
| 8651. | KRHVGINNPHH; |
| 8652. | RRHVGINNPHH; |
| 8653. | HRHVGINNPHH; |
| 8654. | KHKVGINNPHH; |
| 8655. | RHKVGINNPHH; |
| 8656. | HHKVGINNPHH; |
| 8657. | KKKVGINNPHH; |
| 8658. | RKKVGINNPHH; |
| 8659. | HKKVGINNPHH; |
| 8660. | KRKVGINNPHH; |
| 8661. | RRKVGINNPHH; |
| 8662. | HRKVGINNPHH; |
| 8663. | KHRVGINNPHH; |
| 8664. | RHRVGINNPHH; |
| 8665. | HHRVGINNPHH; |
| 8666. | KKRVGINNPHH; |
| 8667. | RKRVGINNPHH; |
| 8668. | HKRVGINNPHH; |

TABLE 7-continued

SEQ ID NO. shown to left of sequence (cont'd)

| SEQ ID NO. | Sequence |
|---|---|
| 8669. | KRRVGINNPHH; |
| 8670. | RRRVGINNPHH; |
| 8671. | HRRVGINNPHH; |
| 8672. | KHHLGVNNPHH; |
| 8673. | RHHLGVNNPHH; |
| 8674. | HHHLGVNNPHH; |
| 8675. | KKHLGVNNPHH; |
| 8676. | RKHLGVNNPHH; |
| 8677. | HKHLGVNNPHH; |
| 8678. | KRHLGVNNPHH; |
| 8679. | RRHLGVNNPHH; |
| 8680. | HRHLGVNNPHH; |
| 8681. | KHKLGVNNPHH; |
| 8682. | RHKLGVNNPHH; |
| 8683. | HHKLGVNNPHH; |
| 8684. | KKKLGVNNPHH; |
| 8685. | RKKLGVNNPHH; |
| 8686. | HKKLGVNNPHH; |
| 8687. | KRKLGVNNPHH; |
| 8688. | RRKLGVNNPHH; |
| 8689. | HRKLGVNNPHH; |
| 8690. | KHRLGVNNPHH; |
| 8691. | RHRLGVNNPHH; |
| 8692. | HHRLGVNNPHH; |
| 8693. | KKRLGVNNPHH; |
| 8694. | RKRLGVNNPHH; |
| 8695. | HKRLGVNNPHH; |
| 8696. | KRRLGVNNPHH; |
| 8697. | RRRLGVNNPHH; |
| 8698. | HRRLGVNNPHH; |
| 8699. | KHHIGVNNPHH; |
| 8700. | RHHIGVNNPHH; |
| 8701. | HHHIGVNNPHH; |
| 8702. | KKHIGVNNPHH; |
| 8703. | RKHIGVNNPHH; |
| 8704. | HKHIGVNNPHH; |
| 8705. | KRHIGVNNPHH; |
| 8706. | RRHIGVNNPHH; |
| 8707. | HRHIGVNNPHH; |

TABLE 7-continued

SEQ ID NO. shown to left of sequence (cont'd)

| SEQ ID NO. | Sequence |
|---|---|
| 8708. | KHKIGVNNPHH; |
| 8709. | RHKIGVNNPHH; |
| 8710. | HHKIGVNNPHH; |
| 8711. | KKKIGVNNPHH; |
| 8712. | RKKIGVNNPHH; |
| 8713. | HKKIGVNNPHH; |
| 8714. | KRKIGVNNPHH; |
| 8715. | RRKIGVNNPHH; |
| 8716. | HRKIGVNNPHH; |
| 8717. | KHRIGVNNPHH; |
| 8718. | RHRIGVNNPHH; |
| 8719. | HHRIGVNNPHH; |
| 8720. | KKRIGVNNPHH; |
| 8721. | RKRIGVNNPHH; |
| 8722. | HKRIGVNNPHH; |
| 8723. | KRRIGVNNPHH; |
| 8724. | RRRIGVNNPHH; |
| 8725. | HRRIGVNNPHH; |
| 8726. | KHHVGVNNPHH; |
| 8727. | RHHVGVNNPHH; |
| 8728. | HHHVGVNNPHH; |
| 8729. | KKHVGVNNPHH; |
| 8730. | RKHVGVNNPHH; |
| 8731. | HKHVGVNNPHH; |
| 8732. | KRHVGVNNPHH; |
| 8733. | RRHVGVNNPHH; |
| 8734. | HRHVGVNNPHH; |
| 8735. | KHKVGVNNPHH; |
| 8736. | RHKVGVNNPHH; |
| 8737. | HHKVGVNNPHH; |
| 8738. | KKKVGVNNPHH; |
| 8739. | RKKVGVNNPHH; |
| 8740. | HKKVGVNNPHH; |
| 8741. | KRKVGVNNPHH; |
| 8742. | RRKVGVNNPHH; |
| 8743. | HRKVGVNNPHH; |
| 8744. | KHRVGVNNPHH; |
| 8745. | RHRVGVNNPHH; |
| 8746. | HHRVGVNNPHH; |
| 8747. | KKRVGVNNPHH; |
| 8748. | RKRVGVNNPHH; |
| 8749. | HKRVGVNNPHH; |
| 8750. | KRRVGVNNPHH; |
| 8751. | RRRVGVNNPHH; |
| 8752. | HRRVGVNNPHH |

SEQUENCE LISTING (8755 sequences)

SEQ ID NO: 1 - protein, 13 aa, Artificial
  IGFBP-2 heparin binding domain-containing peptide sequence
KHHLGLEEPKKLR

SEQ ID NO: 2 - protein, 11 aa, Artificial
  IGFBP-2 heparin binding domain-containing peptide sequence
KHHLGLEEPKK

SEQ ID NO: 3 - protein, 11 aa, Artificial
  IGFBP-2 heparin binding domain-containing peptide sequence
HLGLEEPKKLR

SEQ ID NO: 4 - protein, 13 aa, Artificial
  General heparin binding domain-containing peptide sequence
  MISC_FEATURE (1)..(2): Xaa is optionally present and when present is a positively charged amino acid at pH 6.0
  misc_feature (3)..(9): Xaa can be any naturally occurring amino acid
  MISC_FEATURE (10)..(11): Xaa is a positively charged amino acid at pH 6.0
  MISC_FEATURE (12)..(12): Xaa is optionally present and when present can be any naturally occurring amino acid
  MISC_FEATURE (13)..(13): Xaa is optionally present and when present is a positively charged amino acid at pH 6.0
XXXXXXXXXXXXX

SEQ ID NO: 5 - protein, 11 aa, Artificial
  IGFBP-2 heparin binding domain-containing peptide sequence
KHHLGLEEPKK

SEQ ID NO: 6 - protein, 11 aa, Artificial
  IGFBP-2 heparin binding domain-containing peptide sequence
RHHLGLEEPKK

SEQ ID NO: 7 - protein, 11 aa, Artificial
  IGFBP-2 heparin binding domain-containing peptide sequence
HHHLGLEEPKK

SEQ ID NO: 8 - protein, 11 aa, Artificial
  IGFBP-2 heparin binding domain-containing peptide sequence
KKHLGLEEPKK

SEQ ID NO: 9 - protein, 11 aa, Artificial
  IGFBP-2 heparin binding domain-containing peptide sequence
RKHLGLEEPKK

SEQ ID NO: 10 - protein, 11 aa, Artificial
  IGFBP-2 heparin binding domain-containing peptide sequence
HKHLGLEEPKK

SEQ ID NO: 11 - protein, 11 aa, Artificial
  IGFBP-2 heparin binding domain-containing peptide sequence
KRHLGLEEPKK

SEQ ID NO: 12 - protein, 11 aa, Artificial
  IGFBP-2 heparin binding domain-containing peptide sequence
RRHLGLEEPKK

SEQ ID NO: 13 - protein, 11 aa, Artificial
  IGFBP-2 heparin binding domain-containing peptide sequence
HRHLGLEEPKK

SEQ ID NO: 14 - protein, 11 aa, Artificial
  IGFBP-2 heparin binding domain-containing peptide sequence
KHKLGLEEPKK

SEQ ID NO: 15 - protein, 11 aa, Artificial
  IGFBP-2 heparin binding domain-containing peptide sequence
RHKLGLEEPKK

SEQ ID NO: 16 - protein, 11 aa, Artificial
  IGFBP-2 heparin binding domain-containing peptide sequence
HHKLGLEEPKK

SEQ ID NO: 17 - protein, 11 aa, Artificial
  IGFBP-2 heparin binding domain-containing peptide sequence
KKKLGLEEPKK

SEQ ID NO: 18 - protein, 11 aa, Artificial
  IGFBP-2 heparin binding domain-containing peptide sequence
RKKLGLEEPKK

SEQ ID NO: 19 - protein, 11 aa, Artificial
  IGFBP-2 heparin binding domain-containing peptide sequence
HKKLGLEEPKK

SEQ ID NO: 20 - protein, 11 aa, Artificial
  IGFBP-2 heparin binding domain-containing peptide sequence
KRKLGLEEPKK

SEQ ID NO: 21 - protein, 11 aa, Artificial
  IGFBP-2 heparin binding domain-containing peptide sequence
RRKLGLEEPKK

SEQ ID NO: 22 - protein, 11 aa, Artificial
  IGFBP-2 heparin binding domain-containing peptide sequence
HRKLGLEEPKK

SEQ ID NO: 23 - protein, 11 aa, Artificial
  IGFBP-2 heparin binding domain-containing peptide sequence
KHRLGLEEPKK

SEQ ID NO: 24 - protein, 11 aa, Artificial
  IGFBP-2 heparin binding domain-containing peptide sequence
RHRLGLEEPKK

SEQ ID NO: 25 - protein, 11 aa, Artificial
  IGFBP-2 heparin binding domain-containing peptide sequence
HHRLGLEEPKK

SEQ ID NO: 26 - protein, 11 aa, Artificial
  IGFBP-2 heparin binding domain-containing peptide sequence
KKRLGLEEPKK

SEQ ID NO: 27 - protein, 11 aa, Artificial
  IGFBP-2 heparin binding domain-containing peptide sequence
RKRLGLEEPKK

SEQ ID NO: 28 - protein, 11 aa, Artificial
  IGFBP-2 heparin binding domain-containing peptide sequence
HKRLGLEEPKK

SEQ ID NO: 29 - protein, 11 aa, Artificial
  IGFBP-2 heparin binding domain-containing peptide sequence
KRRLGLEEPKK

SEQ ID NO: 30 - protein, 11 aa, Artificial
  IGFBP-2 heparin binding domain-containing peptide sequence
RRRLGLEEPKK

SEQ ID NO: 31 - protein, 11 aa, Artificial
  IGFBP-2 heparin binding domain-containing peptide sequence
HRRLGLEEPKK

SEQ ID NO: 32 - protein, 11 aa, Artificial
  IGFBP-2 heparin binding domain-containing peptide sequence
KHHIGLEEPKK

SEQ ID NO: 33 - protein, 11 aa, Artificial
  IGFBP-2 heparin binding domain-containing peptide sequence
RHHIGLEEPKK

SEQ ID NO: 34 - protein, 11 aa, Artificial
  IGFBP-2 heparin binding domain-containing peptide sequence
HHHIGLEEPKK

SEQ ID NO: 35 - protein, 11 aa, Artificial
  IGFBP-2 heparin binding domain-containing peptide sequence
KKHIGLEEPKK

SEQ ID NO: 36 - protein, 11 aa, Artificial
  IGFBP-2 heparin binding domain-containing peptide sequence
RKHIGLEEPKK

SEQ ID NO: 37 - protein, 11 aa, Artificial
  IGFBP-2 heparin binding domain-containing peptide sequence
HKHIGLEEPKK

SEQ ID NO: 38 - protein, 11 aa, Artificial
  IGFBP-2 heparin binding domain-containing peptide sequence
KRHIGLEEPKK

SEQ ID NO: 39 - protein, 11 aa, Artificial
  IGFBP-2 heparin binding domain-containing peptide sequence
RRHIGLEEPKK

SEQ ID NO: 40 - protein, 11 aa, Artificial
  IGFBP-2 heparin binding domain-containing peptide sequence
HRHIGLEEPKK

SEQ ID NO: 41 - protein, 11 aa, Artificial
  IGFBP-2 heparin binding domain-containing peptide sequence
KHKIGLEEPKK

SEQ ID NO: 42 - protein, 11 aa, Artificial
  IGFBP-2 heparin binding domain-containing peptide sequence
RHKIGLEEPKK

SEQ ID NO: 43 - protein, 11 aa, Artificial
  IGFBP-2 heparin binding domain-containing peptide sequence
HHKIGLEEPKK

SEQ ID NO: 44 - protein, 11 aa, Artificial
  IGFBP-2 heparin binding domain-containing peptide sequence
KKKIGLEEPKK

SEQ ID NO: 45 - protein, 11 aa, Artificial
  IGFBP-2 heparin binding domain-containing peptide sequence
RKKIGLEEPKK

SEQ ID NO: 46 - protein, 11 aa, Artificial
  IGFBP-2 heparin binding domain-containing peptide sequence
HKKIGLEEPKK

SEQ ID NO: 47 - protein, 11 aa, Artificial
  IGFBP-2 heparin binding domain-containing peptide sequence
KRKIGLEEPKK

SEQ ID NO: 48 - protein, 11 aa, Artificial
  IGFBP-2 heparin binding domain-containing peptide sequence
RRKIGLEEPKK

SEQ ID NO: 49 - protein, 11 aa, Artificial
  IGFBP-2 heparin binding domain-containing peptide sequence
HRKIGLEEPKK

SEQ ID NO: 50 - protein, 11 aa, Artificial
  IGFBP-2 heparin binding domain-containing peptide sequence
KHRIGLEEPKK

SEQ ID NO: 51 - protein, 11 aa, Artificial
  IGFBP-2 heparin binding domain-containing peptide sequence
RHRIGLEEPKK

SEQ ID NO: 52 - protein, 11 aa, Artificial
  IGFBP-2 heparin binding domain-containing peptide sequence
HHRIGLEEPKK

SEQ ID NO: 53 - protein, 11 aa, Artificial
  IGFBP-2 heparin binding domain-containing peptide sequence
KKRIGLEEPKK

SEQ ID NO: 54 - protein, 11 aa, Artificial
  IGFBP-2 heparin binding domain-containing peptide sequence
RKRIGLEEPKK

SEQ ID NO: 55 - protein, 11 aa, Artificial
  IGFBP-2 heparin binding domain-containing peptide sequence
HKRIGLEEPKK

SEQ ID NO: 56 - protein, 11 aa, Artificial
  IGFBP-2 heparin binding domain-containing peptide sequence
KRRIGLEEPKK

SEQ ID NO: 57 - protein, 11 aa, Artificial
  IGFBP-2 heparin binding domain-containing peptide sequence
RRRIGLEEPKK

SEQ ID NO: 58 - protein, 11 aa, Artificial
  IGFBP-2 heparin binding domain-containing peptide sequence
HRRIGLEEPKK

SEQ ID NO: 59 - protein, 11 aa, Artificial
  IGFBP-2 heparin binding domain-containing peptide sequence
KHHVGLEEPKK

SEQ ID NO: 60 - protein, 11 aa, Artificial
  IGFBP-2 heparin binding domain-containing peptide sequence
RHHVGLEEPKK

SEQ ID NO: 61 - protein, 11 aa, Artificial
  IGFBP-2 heparin binding domain-containing peptide sequence
HHHVGLEEPKK

SEQ ID NO: 62 - protein, 11 aa, Artificial
  IGFBP-2 heparin binding domain-containing peptide sequence
KKHVGLEEPKK

SEQ ID NO: 63 - protein, 11 aa, Artificial
  IGFBP-2 heparin binding domain-containing peptide sequence
RKHVGLEEPKK

SEQ ID NO: 64 - protein, 11 aa, Artificial
  IGFBP-2 heparin binding domain-containing peptide sequence
HKHVGLEEPKK

SEQ ID NO: 65 - protein, 11 aa, Artificial
  IGFBP-2 heparin binding domain-containing peptide sequence
KRHVGLEEPKK

SEQ ID NO: 66 - protein, 11 aa, Artificial
  IGFBP-2 heparin binding domain-containing peptide sequence
RRHVGLEEPKK

SEQ ID NO: 67 - protein, 11 aa, Artificial
  IGFBP-2 heparin binding domain-containing peptide sequence
HRHVGLEEPKK

SEQ ID NO: 68 - protein, 11 aa, Artificial
  IGFBP-2 heparin binding domain-containing peptide sequence
KHKVGLEEPKK

SEQ ID NO: 69 - protein, 11 aa, Artificial
  IGFBP-2 heparin binding domain-containing peptide sequence
RHKVGLEEPKK

SEQ ID NO: 70 - protein, 11 aa, Artificial
  IGFBP-2 heparin binding domain-containing peptide sequence
HHKVGLEEPKK

SEQ ID NO: 71 - protein, 11 aa, Artificial
  IGFBP-2 heparin binding domain-containing peptide sequence
KKKVGLEEPKK

SEQ ID NO: 72 - protein, 11 aa, Artificial
  IGFBP-2 heparin binding domain-containing peptide sequence
RKKVGLEEPKK

SEQ ID NO: 73 - protein, 11 aa, Artificial
  IGFBP-2 heparin binding domain-containing peptide sequence
HKKVGLEEPKK

SEQ ID NO: 74 - protein, 11 aa, Artificial
  IGFBP-2 heparin binding domain-containing peptide sequence
KRKVGLEEPKK

SEQ ID NO: 75 - protein, 11 aa, Artificial
  IGFBP-2 heparin binding domain-containing peptide sequence
RRKVGLEEPKK

SEQ ID NO: 76 - protein, 11 aa, Artificial
  IGFBP-2 heparin binding domain-containing peptide sequence
HRKVGLEEPKK

SEQ ID NO: 77 - protein, 11 aa, Artificial
  IGFBP-2 heparin binding domain-containing peptide sequence
KHRVGLEEPKK

SEQ ID NO: 78 - protein, 11 aa, Artificial
  IGFBP-2 heparin binding domain-containing peptide sequence
RHRVGLEEPKK

SEQ ID NO: 79 - protein, 11 aa, Artificial
  IGFBP-2 heparin binding domain-containing peptide sequence
HHRVGLEEPKK

SEQ ID NO: 80 - protein, 11 aa, Artificial
  IGFBP-2 heparin binding domain-containing peptide sequence
KKRVGLEEPKK

SEQ ID NO: 81 - protein, 11 aa, Artificial
  IGFBP-2 heparin binding domain-containing peptide sequence
RKRVGLEEPKK

SEQ ID NO: 82 - protein, 11 aa, Artificial
  IGFBP-2 heparin binding domain-containing peptide sequence
HKRVGLEEPKK

SEQ ID NO: 83 - protein, 11 aa, Artificial
  IGFBP-2 heparin binding domain-containing peptide sequence
KRRVGLEEPKK

SEQ ID NO: 84 - protein, 11 aa, Artificial
  IGFBP-2 heparin binding domain-containing peptide sequence
RRRVGLEEPKK

SEQ ID NO: 85 - protein, 11 aa, Artificial
  IGFBP-2 heparin binding domain-containing peptide sequence
HRRVGLEEPKK

SEQ ID NO: 86 - protein, 11 aa, Artificial
  IGFBP-2 heparin binding domain-containing peptide sequence
KHHLGIEEPKK

SEQ ID NO: 87 - protein, 11 aa, Artificial
  IGFBP-2 heparin binding domain-containing peptide sequence
RHHLGIEEPKK

SEQ ID NO: 88 - protein, 11 aa, Artificial
  IGFBP-2 heparin binding domain-containing peptide sequence
HHHLGIEEPKK

SEQ ID NO: 89 - protein, 11 aa, Artificial
  IGFBP-2 heparin binding domain-containing peptide sequence
KKHLGIEEPKK

SEQ ID NO: 90 - protein, 11 aa, Artificial
  IGFBP-2 heparin binding domain-containing peptide sequence
RKHLGIEEPKK

SEQ ID NO: 91 - protein, 11 aa, Artificial
  IGFBP-2 heparin binding domain-containing peptide sequence
HKHLGIEEPKK

SEQ ID NO: 92 - protein, 11 aa, Artificial
  IGFBP-2 heparin binding domain-containing peptide sequence
KRHLGIEEPKK

SEQ ID NO: 93 - protein, 11 aa, Artificial
  IGFBP-2 heparin binding domain-containing peptide sequence
RRHLGIEEPKK

SEQ ID NO: 94 - protein, 11 aa, Artificial
  IGFBP-2 heparin binding domain-containing peptide sequence
HRHLGIEEPKK

SEQ ID NO: 95 - protein, 11 aa, Artificial
  IGFBP-2 heparin binding domain-containing peptide sequence
KHKLGIEEPKK

SEQ ID NO: 96 - protein, 11 aa, Artificial
  IGFBP-2 heparin binding domain-containing peptide sequence
RHKLGIEEPKK

SEQ ID NO: 97 - protein, 11 aa, Artificial
  IGFBP-2 heparin binding domain-containing peptide sequence
HHKLGIEEPKK

SEQ ID NO: 98 - protein, 11 aa, Artificial
  IGFBP-2 heparin binding domain-containing peptide sequence
KKKLGIEEPKK

SEQ ID NO: 99 - protein, 11 aa, Artificial
  IGFBP-2 heparin binding domain-containing peptide sequence
RKKLGIEEPKK

SEQ ID NO: 100 - protein, 11 aa, Artificial
  IGFBP-2 heparin binding domain-containing peptide sequence
HKKLGIEEPKK

SEQ ID NO: 101 - protein, 11 aa, Artificial
  IGFBP-2 heparin binding domain-containing peptide sequence
KRKLGIEEPKK

SEQ ID NO: 102 - protein, 11 aa, Artificial
  IGFBP-2 heparin binding domain-containing peptide sequence
RRKLGIEEPKK

SEQ ID NO: 103 - protein, 11 aa, Artificial
  IGFBP-2 heparin binding domain-containing peptide sequence
HRKLGIEEPKK

SEQ ID NO: 104 - protein, 11 aa, Artificial
  IGFBP-2 heparin binding domain-containing peptide sequence
KHRLGIEEPKK

SEQ ID NO: 105 - protein, 11 aa, Artificial
  IGFBP-2 heparin binding domain-containing peptide sequence
RHRLGIEEPKK

SEQ ID NO: 106 - protein, 11 aa, Artificial
  IGFBP-2 heparin binding domain-containing peptide sequence
HHRLGIEEPKK

SEQ ID NO: 107 - protein, 11 aa, Artificial
  IGFBP-2 heparin binding domain-containing peptide sequence
KKRLGIEEPKK

SEQ ID NO: 108 - protein, 11 aa, Artificial
  IGFBP-2 heparin binding domain-containing peptide sequence
RKRLGIEEPKK

SEQ ID NO: 109 - protein, 11 aa, Artificial
  IGFBP-2 heparin binding domain-containing peptide sequence
HKRLGIEEPKK

SEQ ID NO: 110 - protein, 11 aa, Artificial
  IGFBP-2 heparin binding domain-containing peptide sequence
KRRLGIEEPKK

SEQ ID NO: 111 - protein, 11 aa, Artificial
  IGFBP-2 heparin binding domain-containing peptide sequence
RRRLGIEEPKK

SEQ ID NO: 112 - protein, 11 aa, Artificial
  IGFBP-2 heparin binding domain-containing peptide sequence
HRRLGIEEPKK

SEQ ID NO: 113 - protein, 11 aa, Artificial
  IGFBP-2 heparin binding domain-containing peptide sequence
KHHIGIEEPKK

SEQ ID NO: 114 - protein, 11 aa, Artificial
  IGFBP-2 heparin binding domain-containing peptide sequence
RHHIGIEEPKK

SEQ ID NO: 115 - protein, 11 aa, Artificial
  IGFBP-2 heparin binding domain-containing peptide sequence
HHHIGIEEPKK

SEQ ID NO: 116 - protein, 11 aa, Artificial
  IGFBP-2 heparin binding domain-containing peptide sequence
KKHIGIEEPKK

SEQ ID NO: 117 - protein, 11 aa, Artificial
  IGFBP-2 heparin binding domain-containing peptide sequence
RKHIGIEEPKK

SEQ ID NO: 118 - protein, 11 aa, Artificial
  IGFBP-2 heparin binding domain-containing peptide sequence
HKHIGIEEPKK

SEQ ID NO: 119 - protein, 11 aa, Artificial
  IGFBP-2 heparin binding domain-containing peptide sequence
KRHIGIEEPKK

SEQ ID NO: 120 - protein, 11 aa, Artificial
  IGFBP-2 heparin binding domain-containing peptide sequence
RRHIGIEEPKK

SEQ ID NO: 121 - protein, 11 aa, Artificial
  IGFBP-2 heparin binding domain-containing peptide sequence
HRHIGIEEPKK

SEQ ID NO: 122 - protein, 11 aa, Artificial
  IGFBP-2 heparin binding domain-containing peptide sequence
KHKIGIEEPKK

SEQ ID NO: 123 - protein, 11 aa, Artificial
  IGFBP-2 heparin binding domain-containing peptide sequence
RHKIGIEEPKK

SEQ ID NO: 124 - protein, 11 aa, Artificial
  IGFBP-2 heparin binding domain-containing peptide sequence
HHKIGIEEPKK

SEQ ID NO: 125 - protein, 11 aa, Artificial
  IGFBP-2 heparin binding domain-containing peptide sequence
KKKIGIEEPKK

SEQ ID NO: 126 - protein, 11 aa, Artificial
  IGFBP-2 heparin binding domain-containing peptide sequence
RKKIGIEEPKK

SEQ ID NO: 127 - protein, 11 aa, Artificial
  IGFBP-2 heparin binding domain-containing peptide sequence
HKKIGIEEPKK

SEQ ID NO: 128 - protein, 11 aa, Artificial
  IGFBP-2 heparin binding domain-containing peptide sequence
KRKIGIEEPKK

SEQ ID NO: 129 - protein, 11 aa, Artificial
  IGFBP-2 heparin binding domain-containing peptide sequence
RRKIGIEEPKK

SEQ ID NO: 130 - protein, 11 aa, Artificial
  IGFBP-2 heparin binding domain-containing peptide sequence
HRKIGIEEPKK

SEQ ID NO: 131 - protein, 11 aa, Artificial
  IGFBP-2 heparin binding domain-containing peptide sequence
KHRIGIEEPKK

SEQ ID NO: 132 - protein, 11 aa, Artificial
  IGFBP-2 heparin binding domain-containing peptide sequence
RHRIGIEEPKK

SEQ ID NO: 133 - protein, 11 aa, Artificial
  IGFBP-2 heparin binding domain-containing peptide sequence
HHRIGIEEPKK

SEQ ID NO: 134 - protein, 11 aa, Artificial
  IGFBP-2 heparin binding domain-containing peptide sequence
KKRIGIEEPKK

SEQ ID NO: 135 - protein, 11 aa, Artificial
  IGFBP-2 heparin binding domain-containing peptide sequence
RKRIGIEEPKK

SEQ ID NO: 136 - protein, 11 aa, Artificial
  IGFBP-2 heparin binding domain-containing peptide sequence
HKRIGIEEPKK

SEQ ID NO: 137 - protein, 11 aa, Artificial
  IGFBP-2 heparin binding domain-containing peptide sequence
KRRIGIEEPKK

SEQ ID NO: 138 - protein, 11 aa, Artificial
  IGFBP-2 heparin binding domain-containing peptide sequence
RRRIGIEEPKK

SEQ ID NO: 139 - protein, 11 aa, Artificial
  IGFBP-2 heparin binding domain-containing peptide sequence
HRRIGIEEPKK

SEQ ID NO: 140 - protein, 11 aa, Artificial
  IGFBP-2 heparin binding domain-containing peptide sequence
KHHVGIEEPKK

SEQ ID NO: 141 - protein, 11 aa, Artificial
  IGFBP-2 heparin binding domain-containing peptide sequence
RHHVGIEEPKK

SEQ ID NO: 142 - protein, 11 aa, Artificial
  IGFBP-2 heparin binding domain-containing peptide sequence
HHHVGIEEPKK

SEQ ID NO: 143 - protein, 11 aa, Artificial
  IGFBP-2 heparin binding domain-containing peptide sequence
KKHVGIEEPKK

SEQ ID NO: 144 - protein, 11 aa, Artificial
  IGFBP-2 heparin binding domain-containing peptide sequence
RKHVGIEEPKK

SEQ ID NO: 145 - protein, 11 aa, Artificial
  IGFBP-2 heparin binding domain-containing peptide sequence
HKHVGIEEPKK

SEQ ID NO: 146 - protein, 11 aa, Artificial
  IGFBP-2 heparin binding domain-containing peptide sequence
KRHVGIEEPKK

SEQ ID NO: 147 - protein, 11 aa, Artificial
  IGFBP-2 heparin binding domain-containing peptide sequence
RRHVGIEEPKK

SEQ ID NO: 148 - protein, 11 aa, Artificial
  IGFBP-2 heparin binding domain-containing peptide sequence
HRHVGIEEPKK

SEQ ID NO: 149 - protein, 11 aa, Artificial
  IGFBP-2 heparin binding domain-containing peptide sequence
KHKVGIEEPKK

SEQ ID NO: 150 - protein, 11 aa, Artificial
  IGFBP-2 heparin binding domain-containing peptide sequence
RHKVGIEEPKK

SEQ ID NO: 151 - protein, 11 aa, Artificial
  IGFBP-2 heparin binding domain-containing peptide sequence
HHKVGIEEPKK

SEQ ID NO: 152 - protein, 11 aa, Artificial
  IGFBP-2 heparin binding domain-containing peptide sequence
KKKVGIEEPKK

SEQ ID NO: 153 - protein, 11 aa, Artificial
  IGFBP-2 heparin binding domain-containing peptide sequence
RKKVGIEEPKK

SEQ ID NO: 154 - protein, 11 aa, Artificial
  IGFBP-2 heparin binding domain-containing peptide sequence
HKKVGIEEPKK

SEQ ID NO: 155 - protein, 11 aa, Artificial
  IGFBP-2 heparin binding domain-containing peptide sequence
KRKVGIEEPKK

SEQ ID NO: 156 - protein, 11 aa, Artificial
  IGFBP-2 heparin binding domain-containing peptide sequence
RRKVGIEEPKK

SEQ ID NO: 157 - protein, 11 aa, Artificial
  IGFBP-2 heparin binding domain-containing peptide sequence
HRKVGIEEPKK

SEQ ID NO: 158 - protein, 11 aa, Artificial
  IGFBP-2 heparin binding domain-containing peptide sequence
KHRVGIEEPKK

SEQ ID NO: 159 - protein, 11 aa, Artificial
  IGFBP-2 heparin binding domain-containing peptide sequence
RHRVGIEEPKK

SEQ ID NO: 160 - protein, 11 aa, Artificial
  IGFBP-2 heparin binding domain-containing peptide sequence
HHRVGIEEPKK

SEQ ID NO: 161 - protein, 11 aa, Artificial
  IGFBP-2 heparin binding domain-containing peptide sequence
KKRVGIEEPKK

SEQ ID NO: 162 - protein, 11 aa, Artificial
  IGFBP-2 heparin binding domain-containing peptide sequence
RKRVGIEEPKK

SEQ ID NO: 163 - protein, 11 aa, Artificial
  IGFBP-2 heparin binding domain-containing peptide sequence
HKRVGIEEPKK

SEQ ID NO: 164 - protein, 11 aa, Artificial
  IGFBP-2 heparin binding domain-containing peptide sequence
KRRVGIEEPKK

SEQ ID NO: 165 - protein, 11 aa, Artificial
  IGFBP-2 heparin binding domain-containing peptide sequence
RRRVGIEEPKK

SEQ ID NO: 166 - protein, 11 aa, Artificial
  IGFBP-2 heparin binding domain-containing peptide sequence
HRRVGIEEPKK

SEQ ID NO: 167 - protein, 11 aa, Artificial
  IGFBP-2 heparin binding domain-containing peptide sequence
KHHLGVEEPKK

SEQ ID NO: 168 - protein, 11 aa, Artificial
  IGFBP-2 heparin binding domain-containing peptide sequence
RHHLGVEEPKK

SEQ ID NO: 169 - protein, 11 aa, Artificial
  IGFBP-2 heparin binding domain-containing peptide sequence
HHHLGVEEPKK

SEQ ID NO: 170 - protein, 11 aa, Artificial
  IGFBP-2 heparin binding domain-containing peptide sequence
KKHLGVEEPKK

SEQ ID NO: 171 - protein, 11 aa, Artificial
  IGFBP-2 heparin binding domain-containing peptide sequence
RKHLGVEEPKK

SEQ ID NO: 172 - protein, 11 aa, Artificial
  IGFBP-2 heparin binding domain-containing peptide sequence
HKHLGVEEPKK

SEQ ID NO: 173 - protein, 11 aa, Artificial
  IGFBP-2 heparin binding domain-containing peptide sequence
KRHLGVEEPKK

SEQ ID NO: 174 - protein, 11 aa, Artificial
  IGFBP-2 heparin binding domain-containing peptide sequence
RRHLGVEEPKK

SEQ ID NO: 175 - protein, 11 aa, Artificial
  IGFBP-2 heparin binding domain-containing peptide sequence
HRHLGVEEPKK

SEQ ID NO: 176 - protein, 11 aa, Artificial
  IGFBP-2 heparin binding domain-containing peptide sequence
KHKLGVEEPKK

SEQ ID NO: 177 - protein, 11 aa, Artificial
  IGFBP-2 heparin binding domain-containing peptide sequence
RHKLGVEEPKK

SEQ ID NO: 178 - protein, 11 aa, Artificial
  IGFBP-2 heparin binding domain-containing peptide sequence
HHKLGVEEPKK

SEQ ID NO: 179 - protein, 11 aa, Artificial
  IGFBP-2 heparin binding domain-containing peptide sequence
KKKLGVEEPKK

SEQ ID NO: 180 - protein, 11 aa, Artificial
  IGFBP-2 heparin binding domain-containing peptide sequence
RKKLGVEEPKK

SEQ ID NO: 181 - protein, 11 aa, Artificial
  IGFBP-2 heparin binding domain-containing peptide sequence
HKKLGVEEPKK

SEQ ID NO: 182 - protein, 11 aa, Artificial
  IGFBP-2 heparin binding domain-containing peptide sequence
KRKLGVEEPKK

SEQ ID NO: 183 - protein, 11 aa, Artificial
  IGFBP-2 heparin binding domain-containing peptide sequence
RRKLGVEEPKK

SEQ ID NO: 184 - protein, 11 aa, Artificial
  IGFBP-2 heparin binding domain-containing peptide sequence
HRKLGVEEPKK

SEQ ID NO: 185 - protein, 11 aa, Artificial
  IGFBP-2 heparin binding domain-containing peptide sequence
KHRLGVEEPKK

SEQ ID NO: 186 - protein, 11 aa, Artificial
  IGFBP-2 heparin binding domain-containing peptide sequence
RHRLGVEEPKK

SEQ ID NO: 187 - protein, 11 aa, Artificial
  IGFBP-2 heparin binding domain-containing peptide sequence
HHRLGVEEPKK

SEQ ID NO: 188 - protein, 11 aa, Artificial
  IGFBP-2 heparin binding domain-containing peptide sequence
KKRLGVEEPKK

SEQ ID NO: 189 - protein, 11 aa, Artificial
  IGFBP-2 heparin binding domain-containing peptide sequence
RKRLGVEEPKK

SEQ ID NO: 190 - protein, 11 aa, Artificial
  IGFBP-2 heparin binding domain-containing peptide sequence
HKRLGVEEPKK

SEQ ID NO: 191 - protein, 11 aa, Artificial
  IGFBP-2 heparin binding domain-containing peptide sequence
KRRLGVEEPKK

SEQ ID NO: 192 - protein, 11 aa, Artificial
  IGFBP-2 heparin binding domain-containing peptide sequence
RRRLGVEEPKK

SEQ ID NO: 193 - protein, 11 aa, Artificial
  IGFBP-2 heparin binding domain-containing peptide sequence
HRRLGVEEPKK

SEQ ID NO: 194 - protein, 11 aa, Artificial
  IGFBP-2 heparin binding domain-containing peptide sequence
KHHIGVEEPKK

SEQ ID NO: 195 - protein, 11 aa, Artificial
  IGFBP-2 heparin binding domain-containing peptide sequence
RHHIGVEEPKK

SEQ ID NO: 196 - protein, 11 aa, Artificial
  IGFBP-2 heparin binding domain-containing peptide sequence
HHHIGVEEPKK

SEQ ID NO: 197 - protein, 11 aa, Artificial
  IGFBP-2 heparin binding domain-containing peptide sequence
KKHIGVEEPKK

SEQ ID NO: 198 - protein, 11 aa, Artificial
  IGFBP-2 heparin binding domain-containing peptide sequence
RKHIGVEEPKK

SEQ ID NO: 199 - protein, 11 aa, Artificial
  IGFBP-2 heparin binding domain-containing peptide sequence
HKHIGVEEPKK

SEQ ID NO: 200 - protein, 11 aa, Artificial
  IGFBP-2 heparin binding domain-containing peptide sequence
KRHIGVEEPKK

SEQ ID NO: 201 - protein, 11 aa, Artificial
  IGFBP-2 heparin binding domain-containing peptide sequence
RRHIGVEEPKK

SEQ ID NO: 202 - protein, 11 aa, Artificial
  IGFBP-2 heparin binding domain-containing peptide sequence
HRHIGVEEPKK

SEQ ID NO: 203 - protein, 11 aa, Artificial
  IGFBP-2 heparin binding domain-containing peptide sequence
KHKIGVEEPKK

SEQ ID NO: 204 - protein, 11 aa, Artificial
  IGFBP-2 heparin binding domain-containing peptide sequence
RHKIGVEEPKK

SEQ ID NO: 205 - protein, 11 aa, Artificial
  IGFBP-2 heparin binding domain-containing peptide sequence
HHKIGVEEPKK

SEQ ID NO: 206 - protein, 11 aa, Artificial
  IGFBP-2 heparin binding domain-containing peptide sequence
KKKIGVEEPKK

SEQ ID NO: 207 - protein, 11 aa, Artificial
  IGFBP-2 heparin binding domain-containing peptide sequence
RKKIGVEEPKK

SEQ ID NO: 208 - protein, 11 aa, Artificial
  IGFBP-2 heparin binding domain-containing peptide sequence
HKKIGVEEPKK

SEQ ID NO: 209 - protein, 11 aa, Artificial
  IGFBP-2 heparin binding domain-containing peptide sequence
KRKIGVEEPKK

SEQ ID NO: 210 - protein, 11 aa, Artificial
  IGFBP-2 heparin binding domain-containing peptide sequence
RRKIGVEEPKK

SEQ ID NO: 211 - protein, 11 aa, Artificial
  IGFBP-2 heparin binding domain-containing peptide sequence
HRKIGVEEPKK

SEQ ID NO: 212 - protein, 11 aa, Artificial
  IGFBP-2 heparin binding domain-containing peptide sequence
KHRIGVEEPKK

SEQ ID NO: 213 - protein, 11 aa, Artificial
  IGFBP-2 heparin binding domain-containing peptide sequence
RHRIGVEEPKK

SEQ ID NO: 214 - protein, 11 aa, Artificial
  IGFBP-2 heparin binding domain-containing peptide sequence
HHRIGVEEPKK

SEQ ID NO: 215 - protein, 11 aa, Artificial
  IGFBP-2 heparin binding domain-containing peptide sequence
KKRIGVEEPKK

SEQ ID NO: 216 - protein, 11 aa, Artificial
  IGFBP-2 heparin binding domain-containing peptide sequence
RKRIGVEEPKK

SEQ ID NO: 217 - protein, 11 aa, Artificial
  IGFBP-2 heparin binding domain-containing peptide sequence
HKRIGVEEPKK

SEQ ID NO: 218 - protein, 11 aa, Artificial
  IGFBP-2 heparin binding domain-containing peptide sequence
KRRIGVEEPKK

SEQ ID NO: 219 - protein, 11 aa, Artificial
  IGFBP-2 heparin binding domain-containing peptide sequence
RRRIGVEEPKK

SEQ ID NO: 220 - protein, 11 aa, Artificial
  IGFBP-2 heparin binding domain-containing peptide sequence
HRRIGVEEPKK

SEQ ID NO: 221 - protein, 11 aa, Artificial
  IGFBP-2 heparin binding domain-containing peptide sequence
KHHVGVEEPKK

SEQ ID NO: 222 - protein, 11 aa, Artificial
  IGFBP-2 heparin binding domain-containing peptide sequence
RHHVGVEEPKK

SEQ ID NO: 223 - protein, 11 aa, Artificial
  IGFBP-2 heparin binding domain-containing peptide sequence
HHHVGVEEPKK

SEQ ID NO: 224 - protein, 11 aa, Artificial
  IGFBP-2 heparin binding domain-containing peptide sequence
KKHVGVEEPKK

SEQ ID NO: 225 - protein, 11 aa, Artificial
  IGFBP-2 heparin binding domain-containing peptide sequence
RKHVGVEEPKK

SEQ ID NO: 226 - protein, 11 aa, Artificial
  IGFBP-2 heparin binding domain-containing peptide sequence
HKHVGVEEPKK

SEQ ID NO: 227 - protein, 11 aa, Artificial
  IGFBP-2 heparin binding domain-containing peptide sequence
KRHVGVEEPKK

SEQ ID NO: 228 - protein, 11 aa, Artificial
  IGFBP-2 heparin binding domain-containing peptide sequence
RRHVGVEEPKK

SEQ ID NO: 229 - protein, 11 aa, Artificial
  IGFBP-2 heparin binding domain-containing peptide sequence
HRHVGVEEPKK

SEQ ID NO: 230 - protein, 11 aa, Artificial
  IGFBP-2 heparin binding domain-containing peptide sequence
KHKVGVEEPKK

SEQ ID NO: 231 - protein, 11 aa, Artificial
  IGFBP-2 heparin binding domain-containing peptide sequence
RHKVGVEEPKK

SEQ ID NO: 232 - protein, 11 aa, Artificial
  IGFBP-2 heparin binding domain-containing peptide sequence
HHKVGVEEPKK

SEQ ID NO: 233 - protein, 11 aa, Artificial
  IGFBP-2 heparin binding domain-containing peptide sequence
KKKVGVEEPKK

SEQ ID NO: 234 - protein, 11 aa, Artificial
  IGFBP-2 heparin binding domain-containing peptide sequence
RKKVGVEEPKK

SEQ ID NO: 235 - protein, 11 aa, Artificial
  IGFBP-2 heparin binding domain-containing peptide sequence
HKKVGVEEPKK

SEQ ID NO: 236 - protein, 11 aa, Artificial
  IGFBP-2 heparin binding domain-containing peptide sequence
KRKVGVEEPKK

SEQ ID NO: 237 - protein, 11 aa, Artificial
  IGFBP-2 heparin binding domain-containing peptide sequence
RRKVGVEEPKK

SEQ ID NO: 238 - protein, 11 aa, Artificial
  IGFBP-2 heparin binding domain-containing peptide sequence
HRKVGVEEPKK

SEQ ID NO: 239 - protein, 11 aa, Artificial
  IGFBP-2 heparin binding domain-containing peptide sequence
KHRVGVEEPKK

SEQ ID NO: 240 - protein, 11 aa, Artificial
  IGFBP-2 heparin binding domain-containing peptide sequence
RHRVGVEEPKK

SEQ ID NO: 241 - protein, 11 aa, Artificial
  IGFBP-2 heparin binding domain-containing peptide sequence
HHRVGVEEPKK

SEQ ID NO: 242 - protein, 11 aa, Artificial
  IGFBP-2 heparin binding domain-containing peptide sequence
KKRVGVEEPKK

SEQ ID NO: 243 - protein, 11 aa, Artificial
  IGFBP-2 heparin binding domain-containing peptide sequence
RKRVGVEEPKK

SEQ ID NO: 244 - protein, 11 aa, Artificial
  IGFBP-2 heparin binding domain-containing peptide sequence
HKRVGVEEPKK

SEQ ID NO: 245 - protein, 11 aa, Artificial
  IGFBP-2 heparin binding domain-containing peptide sequence
KRRVGVEEPKK

SEQ ID NO: 246 - protein, 11 aa, Artificial
  IGFBP-2 heparin binding domain-containing peptide sequence
RRRVGVEEPKK

SEQ ID NO: 247 - protein, 11 aa, Artificial
  IGFBP-2 heparin binding domain-containing peptide sequence
HRRVGVEEPKK

SEQ ID NO: 248 - protein, 11 aa, Artificial
  IGFBP-2 heparin binding domain-containing peptide sequence
KHHLGLNEPKK

SEQ ID NO: 249 - protein, 11 aa, Artificial
  IGFBP-2 heparin binding domain-containing peptide sequence
RHHLGLNEPKK

SEQ ID NO: 250 - protein, 11 aa, Artificial
  IGFBP-2 heparin binding domain-containing peptide sequence
HHHLGLNEPKK

SEQ ID NO: 251 - protein, 11 aa, Artificial
  IGFBP-2 heparin binding domain-containing peptide sequence
KKHLGLNEPKK

SEQ ID NO: 252 - protein, 11 aa, Artificial
  IGFBP-2 heparin binding domain-containing peptide sequence
RKHLGLNEPKK

SEQ ID NO: 253 - protein, 11 aa, Artificial
  IGFBP-2 heparin binding domain-containing peptide sequence
HKHLGLNEPKK

SEQ ID NO: 254 - protein, 11 aa, Artificial
  IGFBP-2 heparin binding domain-containing peptide sequence
KRHLGLNEPKK

SEQ ID NO: 255 - protein, 11 aa, Artificial
  IGFBP-2 heparin binding domain-containing peptide sequence
RRHLGLNEPKK

SEQ ID NO: 256 - protein, 11 aa, Artificial
  IGFBP-2 heparin binding domain-containing peptide sequence
HRHLGLNEPKK

SEQ ID NO: 257 - protein, 11 aa, Artificial
  IGFBP-2 heparin binding domain-containing peptide sequence
KHKLGLNEPKK

SEQ ID NO: 258 - protein, 11 aa, Artificial
  IGFBP-2 heparin binding domain-containing peptide sequence
RHKLGLNEPKK

SEQ ID NO: 259 - protein, 11 aa, Artificial
  IGFBP-2 heparin binding domain-containing peptide sequence
HHKLGLNEPKK

SEQ ID NO: 260 - protein, 11 aa, Artificial
  IGFBP-2 heparin binding domain-containing peptide sequence
KKKLGLNEPKK

SEQ ID NO: 261 - protein, 11 aa, Artificial
  IGFBP-2 heparin binding domain-containing peptide sequence
RKKLGLNEPKK

SEQ ID NO: 262 - protein, 11 aa, Artificial
  IGFBP-2 heparin binding domain-containing peptide sequence
HKKLGLNEPKK

SEQ ID NO: 263 - protein, 11 aa, Artificial
  IGFBP-2 heparin binding domain-containing peptide sequence
KRKLGLNEPKK

SEQ ID NO: 264 - protein, 11 aa, Artificial
  IGFBP-2 heparin binding domain-containing peptide sequence
RRKLGLNEPKK

SEQ ID NO: 265 - protein, 11 aa, Artificial
  IGFBP-2 heparin binding domain-containing peptide sequence
HRKLGLNEPKK

SEQ ID NO: 266 - protein, 11 aa, Artificial
  IGFBP-2 heparin binding domain-containing peptide sequence
KHRLGLNEPKK

SEQ ID NO: 267 - protein, 11 aa, Artificial
  IGFBP-2 heparin binding domain-containing peptide sequence
RHRLGLNEPKK

SEQ ID NO: 268 - protein, 11 aa, Artificial
  IGFBP-2 heparin binding domain-containing peptide sequence
HHRLGLNEPKK

SEQ ID NO: 269 - protein, 11 aa, Artificial
  IGFBP-2 heparin binding domain-containing peptide sequence
KKRLGLNEPKK

SEQ ID NO: 270 - protein, 11 aa, Artificial
  IGFBP-2 heparin binding domain-containing peptide sequence
RKRLGLNEPKK

SEQ ID NO: 271 - protein, 11 aa, Artificial
  IGFBP-2 heparin binding domain-containing peptide sequence
HKRLGLNEPKK

SEQ ID NO: 272 - protein, 11 aa, Artificial
  IGFBP-2 heparin binding domain-containing peptide sequence
KRRLGLNEPKK

SEQ ID NO: 273 - protein, 11 aa, Artificial
  IGFBP-2 heparin binding domain-containing peptide sequence
RRRLGLNEPKK

SEQ ID NO: 274 - protein, 11 aa, Artificial
  IGFBP-2 heparin binding domain-containing peptide sequence
HRRLGLNEPKK

SEQ ID NO: 275 - protein, 10 aa, Artificial
  IGFBP-2 heparin binding domain-containing peptide sequence
KHHIGLNPKK

SEQ ID NO: 276 - protein, 11 aa, Artificial
  IGFBP-2 heparin binding domain-containing peptide sequence
RHHIGLNEPKK

SEQ ID NO: 277 - protein, 11 aa, Artificial
  IGFBP-2 heparin binding domain-containing peptide sequence
HHHIGLNEPKK

SEQ ID NO: 278 - protein, 11 aa, Artificial
  IGFBP-2 heparin binding domain-containing peptide sequence
KKHIGLNEPKK

SEQ ID NO: 279 - protein, 11 aa, Artificial
  IGFBP-2 heparin binding domain-containing peptide sequence
RKHIGLNEPKK

SEQ ID NO: 280 - protein, 11 aa, Artificial
  IGFBP-2 heparin binding domain-containing peptide sequence
HKHIGLNEPKK

SEQ ID NO: 281 - protein, 11 aa, Artificial
  IGFBP-2 heparin binding domain-containing peptide sequence
KRHIGLNEPKK

SEQ ID NO: 282 - protein, 11 aa, Artificial
  IGFBP-2 heparin binding domain-containing peptide sequence
RRHIGLNEPKK

SEQ ID NO: 283 - protein, 11 aa, Artificial
  IGFBP-2 heparin binding domain-containing peptide sequence
HRHIGLNEPKK

SEQ ID NO: 284 - protein, 11 aa, Artificial
  IGFBP-2 heparin binding domain-containing peptide sequence
KHKIGLNEPKK

SEQ ID NO: 285 - protein, 11 aa, Artificial
  IGFBP-2 heparin binding domain-containing peptide sequence
RHKIGLNEPKK

SEQ ID NO: 286 - protein, 11 aa, Artificial
  IGFBP-2 heparin binding domain-containing peptide sequence
HHKIGLNEPKK

SEQ ID NO: 287 - protein, 11 aa, Artificial
  IGFBP-2 heparin binding domain-containing peptide sequence
KKKIGLNEPKK

SEQ ID NO: 288 - protein, 11 aa, Artificial
  IGFBP-2 heparin binding domain-containing peptide sequence
RKKIGLNEPKK

SEQ ID NO: 289 - protein, 11 aa, Artificial
  IGFBP-2 heparin binding domain-containing peptide sequence
HKKIGLNEPKK

SEQ ID NO: 290 - protein, 11 aa, Artificial
  IGFBP-2 heparin binding domain-containing peptide sequence
KRKIGLNEPKK

SEQ ID NO: 291 - protein, 11 aa, Artificial
  IGFBP-2 heparin binding domain-containing peptide sequence
RRKIGLNEPKK

SEQ ID NO: 292 - protein, 11 aa, Artificial
  IGFBP-2 heparin binding domain-containing peptide sequence
HRKIGLNEPKK

SEQ ID NO: 293 - protein, 11 aa, Artificial
  IGFBP-2 heparin binding domain-containing peptide sequence
KHRIGLNEPKK

SEQ ID NO: 294 - protein, 11 aa, Artificial
  IGFBP-2 heparin binding domain-containing peptide sequence
RHRIGLNEPKK

SEQ ID NO: 295 - protein, 11 aa, Artificial
  IGFBP-2 heparin binding domain-containing peptide sequence
HHRIGLNEPKK

SEQ ID NO: 296 - protein, 11 aa, Artificial
  IGFBP-2 heparin binding domain-containing peptide sequence
KKRIGLNEPKK

SEQ ID NO: 297 - protein, 11 aa, Artificial
  IGFBP-2 heparin binding domain-containing peptide sequence
RKRIGLNEPKK

SEQ ID NO: 298 - protein, 11 aa, Artificial
  IGFBP-2 heparin binding domain-containing peptide sequence
HKRIGLNEPKK

SEQ ID NO: 299 - protein, 11 aa, Artificial
  IGFBP-2 heparin binding domain-containing peptide sequence
KRRIGLNEPKK

SEQ ID NO: 300 - protein, 11 aa, Artificial
  IGFBP-2 heparin binding domain-containing peptide sequence
RRRIGLNEPKK

SEQ ID NO: 301 - protein, 11 aa, Artificial
  IGFBP-2 heparin binding domain-containing peptide sequence
HRRIGLNEPKK

SEQ ID NO: 302 - protein, 11 aa, Artificial
  IGFBP-2 heparin binding domain-containing peptide sequence
KHHVGLNEPKK

SEQ ID NO: 303 - protein, 11 aa, Artificial
  IGFBP-2 heparin binding domain-containing peptide sequence
RHHVGLNEPKK

SEQ ID NO: 304 - protein, 11 aa, Artificial
  IGFBP-2 heparin binding domain-containing peptide sequence
HHHVGLNEPKK

SEQ ID NO: 305 - protein, 11 aa, Artificial
  IGFBP-2 heparin binding domain-containing peptide sequence
KKHVGLNEPKK

SEQ ID NO: 306 - protein, 11 aa, Artificial
  IGFBP-2 heparin binding domain-containing peptide sequence
RKHVGLNEPKK

SEQ ID NO: 307 - protein, 11 aa, Artificial
  IGFBP-2 heparin binding domain-containing peptide sequence
HKHVGLNEPKK

SEQ ID NO: 308 - protein, 11 aa, Artificial
  IGFBP-2 heparin binding domain-containing peptide sequence
KRHVGLNEPKK

SEQ ID NO: 309 - protein, 11 aa, Artificial
  IGFBP-2 heparin binding domain-containing peptide sequence
RRHVGLNEPKK

SEQ ID NO: 310 - protein, 11 aa, Artificial
  IGFBP-2 heparin binding domain-containing peptide sequence
HRHVGLNEPKK

SEQ ID NO: 311 - protein, 11 aa, Artificial
  IGFBP-2 heparin binding domain-containing peptide sequence
KHKVGLNEPKK

SEQ ID NO: 312 - protein, 11 aa, Artificial
  IGFBP-2 heparin binding domain-containing peptide sequence
RHKVGLNEPKK

SEQ ID NO: 313 - protein, 11 aa, Artificial
  IGFBP-2 heparin binding domain-containing peptide sequence
HHKVGLNEPKK

SEQ ID NO: 314 - protein, 11 aa, Artificial
  IGFBP-2 heparin binding domain-containing peptide sequence
KKKVGLNEPKK

SEQ ID NO: 315 - protein, 11 aa, Artificial
  IGFBP-2 heparin binding domain-containing peptide sequence
RKKVGLNEPKK

SEQ ID NO: 316 - protein, 11 aa, Artificial
  IGFBP-2 heparin binding domain-containing peptide sequence
HKKVGLNEPKK

SEQ ID NO: 317 - protein, 11 aa, Artificial
  IGFBP-2 heparin binding domain-containing peptide sequence
KRKVGLNEPKK

SEQ ID NO: 318 - protein, 11 aa, Artificial
  IGFBP-2 heparin binding domain-containing peptide sequence
RRKVGLNEPKK

SEQ ID NO: 319 - protein, 11 aa, Artificial
  IGFBP-2 heparin binding domain-containing peptide sequence
HRKVGLNEPKK

SEQ ID NO: 320 - protein, 11 aa, Artificial
  IGFBP-2 heparin binding domain-containing peptide sequence
KHRVGLNEPKK

SEQ ID NO: 321 - protein, 11 aa, Artificial
  IGFBP-2 heparin binding domain-containing peptide sequence
RHRVGLNEPKK

SEQ ID NO: 322 - protein, 11 aa, Artificial
  IGFBP-2 heparin binding domain-containing peptide sequence
HHRVGLNEPKK

SEQ ID NO: 323 - protein, 11 aa, Artificial
  IGFBP-2 heparin binding domain-containing peptide sequence
KKRVGLNEPKK

SEQ ID NO: 324 - protein, 11 aa, Artificial
  IGFBP-2 heparin binding domain-containing peptide sequence
RKRVGLNEPKK

SEQ ID NO: 325 - protein, 11 aa, Artificial
  IGFBP-2 heparin binding domain-containing peptide sequence
HKRVGLNEPKK

SEQ ID NO: 326 - protein, 11 aa, Artificial
  IGFBP-2 heparin binding domain-containing peptide sequence
KRRVGLNEPKK

SEQ ID NO: 327 - protein, 11 aa, Artificial
  IGFBP-2 heparin binding domain-containing peptide sequence
RRRVGLNEPKK

SEQ ID NO: 328 - protein, 11 aa, Artificial
  IGFBP-2 heparin binding domain-containing peptide sequence
HRRVGLNEPKK

SEQ ID NO: 329 - protein, 11 aa, Artificial
  IGFBP-2 heparin binding domain-containing peptide sequence
KHHLGINEPKK

SEQ ID NO: 330 - protein, 11 aa, Artificial
  IGFBP-2 heparin binding domain-containing peptide sequence
RHHLGINEPKK

SEQ ID NO: 331 - protein, 11 aa, Artificial
  IGFBP-2 heparin binding domain-containing peptide sequence
HHHLGINEPKK

SEQ ID NO: 332 - protein, 11 aa, Artificial
  IGFBP-2 heparin binding domain-containing peptide sequence
KKHLGINEPKK

SEQ ID NO: 333 - protein, 11 aa, Artificial
  IGFBP-2 heparin binding domain-containing peptide sequence
RKHLGINEPKK

SEQ ID NO: 334 - protein, 11 aa, Artificial
  IGFBP-2 heparin binding domain-containing peptide sequence
HKHLGINEPKK

SEQ ID NO: 335 - protein, 11 aa, Artificial
  IGFBP-2 heparin binding domain-containing peptide sequence
KRHLGINEPKK

SEQ ID NO: 336 - protein, 11 aa, Artificial
  IGFBP-2 heparin binding domain-containing peptide sequence
RRHLGINEPKK

SEQ ID NO: 337 - protein, 11 aa, Artificial
  IGFBP-2 heparin binding domain-containing peptide sequence
HRHLGINEPKK

SEQ ID NO: 338 - protein, 11 aa, Artificial
  IGFBP-2 heparin binding domain-containing peptide sequence
KHKLGINEPKK

SEQ ID NO: 339 - protein, 11 aa, Artificial
  IGFBP-2 heparin binding domain-containing peptide sequence
RHKLGINEPKK

SEQ ID NO: 340 - protein, 11 aa, Artificial
  IGFBP-2 heparin binding domain-containing peptide sequence
HHKLGINEPKK

SEQ ID NO: 341 - protein, 11 aa, Artificial
  IGFBP-2 heparin binding domain-containing peptide sequence
KKKLGINEPKK

SEQ ID NO: 342 - protein, 11 aa, Artificial
  IGFBP-2 heparin binding domain-containing peptide sequence
RKKLGINEPKK

SEQ ID NO: 343 - protein, 11 aa, Artificial
  IGFBP-2 heparin binding domain-containing peptide sequence
HKKLGINEPKK

SEQ ID NO: 344 - protein, 11 aa, Artificial
  IGFBP-2 heparin binding domain-containing peptide sequence
KRKLGINEPKK

SEQ ID NO: 345 - protein, 11 aa, Artificial
  IGFBP-2 heparin binding domain-containing peptide sequence
RRKLGINEPKK

SEQ ID NO: 346 - protein, 11 aa, Artificial
  IGFBP-2 heparin binding domain-containing peptide sequence
HRKLGINEPKK

SEQ ID NO: 347 - protein, 11 aa, Artificial
  IGFBP-2 heparin binding domain-containing peptide sequence
KHRLGINEPKK

SEQ ID NO: 348 - protein, 11 aa, Artificial
  IGFBP-2 heparin binding domain-containing peptide sequence
RHRLGINEPKK

SEQ ID NO: 349 - protein, 11 aa, Artificial
  IGFBP-2 heparin binding domain-containing peptide sequence
HHRLGINEPKK

SEQ ID NO: 350 - protein, 11 aa, Artificial
  IGFBP-2 heparin binding domain-containing peptide sequence
KKRLGINEPKK

SEQ ID NO: 351 - protein, 11 aa, Artificial
  IGFBP-2 heparin binding domain-containing peptide sequence
RKRLGINEPKK

SEQ ID NO: 352 - protein, 11 aa, Artificial
  IGFBP-2 heparin binding domain-containing peptide sequence
HKRLGINEPKK

SEQ ID NO: 353 - protein, 11 aa, Artificial
  IGFBP-2 heparin binding domain-containing peptide sequence
KRRLGINEPKK

SEQ ID NO: 354 - protein, 11 aa, Artificial
  IGFBP-2 heparin binding domain-containing peptide sequence
RRRLGINEPKK

SEQ ID NO: 355 - protein, 11 aa, Artificial
  IGFBP-2 heparin binding domain-containing peptide sequence
HRRLGINEPKK

SEQ ID NO: 356 - protein, 11 aa, Artificial
  IGFBP-2 heparin binding domain-containing peptide sequence
KHHIGIENPKK

SEQ ID NO: 357 - protein, 11 aa, Artificial
  IGFBP-2 heparin binding domain-containing peptide sequence
RHHIGINEPKK

SEQ ID NO: 358 - protein, 11 aa, Artificial
  IGFBP-2 heparin binding domain-containing peptide sequence
HHHIGINEPKK

SEQ ID NO: 359 - protein, 11 aa, Artificial
  IGFBP-2 heparin binding domain-containing peptide sequence
KKHIGINEPKK

SEQ ID NO: 360 - protein, 11 aa, Artificial
  IGFBP-2 heparin binding domain-containing peptide sequence
RKHIGINEPKK

SEQ ID NO: 361 - protein, 11 aa, Artificial
  IGFBP-2 heparin binding domain-containing peptide sequence
HKHIGINEPKK

SEQ ID NO: 362 - protein, 11 aa, Artificial
  IGFBP-2 heparin binding domain-containing peptide sequence
KRHIGINEPKK

SEQ ID NO: 363 - protein, 11 aa, Artificial
  IGFBP-2 heparin binding domain-containing peptide sequence
RRHIGINEPKK

SEQ ID NO: 364 - protein, 11 aa, Artificial
  IGFBP-2 heparin binding domain-containing peptide sequence
HRHIGINEPKK

SEQ ID NO: 365 - protein, 11 aa, Artificial
  IGFBP-2 heparin binding domain-containing peptide sequence
KHKIGINEPKK

SEQ ID NO: 366 - protein, 11 aa, Artificial
  IGFBP-2 heparin binding domain-containing peptide sequence
RHKIGINEPKK

SEQ ID NO: 367 - protein, 11 aa, Artificial
  IGFBP-2 heparin binding domain-containing peptide sequence
HHKIGINEPKK

SEQ ID NO: 368 - protein, 11 aa, Artificial
  IGFBP-2 heparin binding domain-containing peptide sequence
KKKIGINEPKK

SEQ ID NO: 369 - protein, 11 aa, Artificial
  IGFBP-2 heparin binding domain-containing peptide sequence
RKKIGINEPKK

SEQ ID NO: 370 - protein, 11 aa, Artificial
  IGFBP-2 heparin binding domain-containing peptide sequence
HKKIGINEPKK

SEQ ID NO: 371 - protein, 11 aa, Artificial
  IGFBP-2 heparin binding domain-containing peptide sequence
KRKIGINEPKK

SEQ ID NO: 372 - protein, 11 aa, Artificial
  IGFBP-2 heparin binding domain-containing peptide sequence
RRKIGINEPKK

SEQ ID NO: 373 - protein, 11 aa, Artificial
  IGFBP-2 heparin binding domain-containing peptide sequence
HRKIGINEPKK

SEQ ID NO: 374 - protein, 11 aa, Artificial
  IGFBP-2 heparin binding domain-containing peptide sequence
KHRIGINEPKK

SEQ ID NO: 375 - protein, 11 aa, Artificial
  IGFBP-2 heparin binding domain-containing peptide sequence
RHRIGINEPKK

SEQ ID NO: 376 - protein, 11 aa, Artificial
  IGFBP-2 heparin binding domain-containing peptide sequence
HHRIGINEPKK

SEQ ID NO: 377 - protein, 11 aa, Artificial
  IGFBP-2 heparin binding domain-containing peptide sequence
KKRIGINEPKK

SEQ ID NO: 378 - protein, 11 aa, Artificial
  IGFBP-2 heparin binding domain-containing peptide sequence
RKRIGINEPKK

SEQ ID NO: 379 - protein, 11 aa, Artificial
  IGFBP-2 heparin binding domain-containing peptide sequence
HKRIGINEPKK

SEQ ID NO: 380 - protein, 11 aa, Artificial
  IGFBP-2 heparin binding domain-containing peptide sequence
KRRIGINEPKK

SEQ ID NO: 381 - protein, 11 aa, Artificial
  IGFBP-2 heparin binding domain-containing peptide sequence
RRRIGINEPKK

SEQ ID NO: 382 - protein, 11 aa, Artificial
  IGFBP-2 heparin binding domain-containing peptide sequence
HRRIGINEPKK

SEQ ID NO: 383 - protein, 11 aa, Artificial
  IGFBP-2 heparin binding domain-containing peptide sequence
KHHVGINEPKK

SEQ ID NO: 384 - protein, 11 aa, Artificial
  IGFBP-2 heparin binding domain-containing peptide sequence
RHHVGINEPKK

SEQ ID NO: 385 - protein, 11 aa, Artificial
  IGFBP-2 heparin binding domain-containing peptide sequence
HHHVGINEPKK

SEQ ID NO: 386 - protein, 11 aa, Artificial
  IGFBP-2 heparin binding domain-containing peptide sequence
KKHVGINEPKK

SEQ ID NO: 387 - protein, 11 aa, Artificial
  IGFBP-2 heparin binding domain-containing peptide sequence
RKHVGINEPKK

SEQ ID NO: 388 - protein, 11 aa, Artificial
  IGFBP-2 heparin binding domain-containing peptide sequence
HKHVGINEPKK

SEQ ID NO: 389 - protein, 11 aa, Artificial
  IGFBP-2 heparin binding domain-containing peptide sequence
KRHVGINEPKK

SEQ ID NO: 390 - protein, 11 aa, Artificial
  IGFBP-2 heparin binding domain-containing peptide sequence
RRHVGINEPKK

SEQ ID NO: 391 - protein, 11 aa, Artificial
  IGFBP-2 heparin binding domain-containing peptide sequence
HRHVGINEPKK

SEQ ID NO: 392 - protein, 11 aa, Artificial
  IGFBP-2 heparin binding domain-containing peptide sequence
KHKVGINEPKK

SEQ ID NO: 393 - protein, 11 aa, Artificial
  IGFBP-2 heparin binding domain-containing peptide sequence
RHKVGINEPKK

SEQ ID NO: 394 - protein, 11 aa, Artificial
  IGFBP-2 heparin binding domain-containing peptide sequence
HHKVGINEPKK

SEQ ID NO: 395 - protein, 11 aa, Artificial
  IGFBP-2 heparin binding domain-containing peptide sequence
KKKVGINEPKK

SEQ ID NO: 396 - protein, 11 aa, Artificial
  IGFBP-2 heparin binding domain-containing peptide sequence
RKKVGINEPKK

SEQ ID NO: 397 - protein, 11 aa, Artificial
  IGFBP-2 heparin binding domain-containing peptide sequence
HKKVGINEPKK

SEQ ID NO: 398 - protein, 11 aa, Artificial
  IGFBP-2 heparin binding domain-containing peptide sequence
KRKVGINEPKK

SEQ ID NO: 399 - protein, 11 aa, Artificial
  IGFBP-2 heparin binding domain-containing peptide sequence
RRKVGINEPKK

SEQ ID NO: 400 - protein, 11 aa, Artificial
  IGFBP-2 heparin binding domain-containing peptide sequence
HRKVGINEPKK

SEQ ID NO: 401 - protein, 11 aa, Artificial
  IGFBP-2 heparin binding domain-containing peptide sequence
KHRVGINEPKK

SEQ ID NO: 402 - protein, 11 aa, Artificial
  IGFBP-2 heparin binding domain-containing peptide sequence
RHRVGINEPKK

SEQ ID NO: 403 - protein, 11 aa, Artificial
  IGFBP-2 heparin binding domain-containing peptide sequence
HHRVGINEPKK

SEQ ID NO: 404 - protein, 11 aa, Artificial
  IGFBP-2 heparin binding domain-containing peptide sequence
KKRVGINEPKK

SEQ ID NO: 405 - protein, 11 aa, Artificial
  IGFBP-2 heparin binding domain-containing peptide sequence
RKRVGINEPKK

SEQ ID NO: 406 - protein, 11 aa, Artificial
  IGFBP-2 heparin binding domain-containing peptide sequence
HKRVGINEPKK

SEQ ID NO: 407 - protein, 11 aa, Artificial
  IGFBP-2 heparin binding domain-containing peptide sequence
KRRVGINEPKK

SEQ ID NO: 408 - protein, 11 aa, Artificial
  IGFBP-2 heparin binding domain-containing peptide sequence
RRRVGINEPKK

SEQ ID NO: 409 - protein, 11 aa, Artificial
  IGFBP-2 heparin binding domain-containing peptide sequence
HRRVGINEPKK

SEQ ID NO: 410 - protein, 11 aa, Artificial
  IGFBP-2 heparin binding domain-containing peptide sequence
KHHLGVNEPKK

SEQ ID NO: 411 - protein, 11 aa, Artificial
  IGFBP-2 heparin binding domain-containing peptide sequence
RHHLGVNEPKK

SEQ ID NO: 412 - protein, 11 aa, Artificial
  IGFBP-2 heparin binding domain-containing peptide sequence
HHHLGVNEPKK

SEQ ID NO: 413 - protein, 11 aa, Artificial
  IGFBP-2 heparin binding domain-containing peptide sequence
KKHLGVNEPKK

SEQ ID NO: 414 - protein, 11 aa, Artificial
  IGFBP-2 heparin binding domain-containing peptide sequence
RKHLGVNEPKK

SEQ ID NO: 415 - protein, 11 aa, Artificial
  IGFBP-2 heparin binding domain-containing peptide sequence
HKHLGVNEPKK

SEQ ID NO: 416 - protein, 11 aa, Artificial
  IGFBP-2 heparin binding domain-containing peptide sequence
KRHLGVNEPKK

SEQ ID NO: 417 - protein, 11 aa, Artificial
  IGFBP-2 heparin binding domain-containing peptide sequence
RRHLGVNEPKK

SEQ ID NO: 418 - protein, 11 aa, Artificial
  IGFBP-2 heparin binding domain-containing peptide sequence
HRHLGVNEPKK

SEQ ID NO: 419 - protein, 11 aa, Artificial
  IGFBP-2 heparin binding domain-containing peptide sequence
KHKLGVNEPKK

SEQ ID NO: 420 - protein, 11 aa, Artificial
  IGFBP-2 heparin binding domain-containing peptide sequence
RHKLGVNEPKK

SEQ ID NO: 421 - protein, 11 aa, Artificial
  IGFBP-2 heparin binding domain-containing peptide sequence
HHKLGVNEPKK

SEQ ID NO: 422 - protein, 11 aa, Artificial
  IGFBP-2 heparin binding domain-containing peptide sequence
KKKLGVNEPKK

SEQ ID NO: 423 - protein, 11 aa, Artificial
  IGFBP-2 heparin binding domain-containing peptide sequence
RKKLGVNEPKK

SEQ ID NO: 424 - protein, 11 aa, Artificial
  IGFBP-2 heparin binding domain-containing peptide sequence
HKKLGVNEPKK

SEQ ID NO: 425 - protein, 11 aa, Artificial
  IGFBP-2 heparin binding domain-containing peptide sequence
KRKLGVNEPKK

SEQ ID NO: 426 - protein, 11 aa, Artificial
  IGFBP-2 heparin binding domain-containing peptide sequence
RRKLGVNEPKK

SEQ ID NO: 427 - protein, 11 aa, Artificial
  IGFBP-2 heparin binding domain-containing peptide sequence
HRKLGVNEPKK

SEQ ID NO: 428 - protein, 11 aa, Artificial
  IGFBP-2 heparin binding domain-containing peptide sequence
KHRLGVNEPKK

SEQ ID NO: 429 - protein, 11 aa, Artificial
  IGFBP-2 heparin binding domain-containing peptide sequence
RHRLGVNEPKK

SEQ ID NO: 430 - protein, 11 aa, Artificial
  IGFBP-2 heparin binding domain-containing peptide sequence
HHRLGVNEPKK

SEQ ID NO: 431 - protein, 11 aa, Artificial
  IGFBP-2 heparin binding domain-containing peptide sequence
KKRLGVNEPKK

SEQ ID NO: 432 - protein, 11 aa, Artificial
  IGFBP-2 heparin binding domain-containing peptide sequence
RKRLGVNEPKK

SEQ ID NO: 433 - protein, 11 aa, Artificial
  IGFBP-2 heparin binding domain-containing peptide sequence
HKRLGVNEPKK

SEQ ID NO: 434 - protein, 11 aa, Artificial
  IGFBP-2 heparin binding domain-containing peptide sequence
KRRLGVNEPKK

SEQ ID NO: 435 - protein, 11 aa, Artificial
  IGFBP-2 heparin binding domain-containing peptide sequence
RRRLGVNEPKK

SEQ ID NO: 436 - protein, 11 aa, Artificial
  IGFBP-2 heparin binding domain-containing peptide sequence
HRRLGVNEPKK

SEQ ID NO: 437 - protein, 11 aa, Artificial
  IGFBP-2 heparin binding domain-containing peptide sequence
KHHIGVNEPKK

SEQ ID NO: 438 - protein, 11 aa, Artificial
  IGFBP-2 heparin binding domain-containing peptide sequence
RHHIGVNEPKK

SEQ ID NO: 439 - protein, 11 aa, Artificial
  IGFBP-2 heparin binding domain-containing peptide sequence
HHHIGVNEPKK

SEQ ID NO: 440 - protein, 11 aa, Artificial
  IGFBP-2 heparin binding domain-containing peptide sequence
KKHIGVNEPKK

SEQ ID NO: 441 - protein, 11 aa, Artificial
  IGFBP-2 heparin binding domain-containing peptide sequence
RKHIGVNEPKK

SEQ ID NO: 442 - protein, 11 aa, Artificial
  IGFBP-2 heparin binding domain-containing peptide sequence
HKHIGVNEPKK

SEQ ID NO: 443 - protein, 11 aa, Artificial
  IGFBP-2 heparin binding domain-containing peptide sequence
KRHIGVNEPKK

SEQ ID NO: 444 - protein, 11 aa, Artificial
  IGFBP-2 heparin binding domain-containing peptide sequence
RRHIGVNEPKK

SEQ ID NO: 445 - protein, 11 aa, Artificial
  IGFBP-2 heparin binding domain-containing peptide sequence
HRHIGVNEPKK

SEQ ID NO: 446 - protein, 11 aa, Artificial
  IGFBP-2 heparin binding domain-containing peptide sequence
KHKIGVNEPKK

SEQ ID NO: 447 - protein, 11 aa, Artificial
  IGFBP-2 heparin binding domain-containing peptide sequence
RHKIGVNEPKK

SEQ ID NO: 448 - protein, 11 aa, Artificial
  IGFBP-2 heparin binding domain-containing peptide sequence
HHKIGVNEPKK

SEQ ID NO: 449 - protein, 11 aa, Artificial
  IGFBP-2 heparin binding domain-containing peptide sequence
KKKIGVNEPKK

SEQ ID NO: 450 - protein, 11 aa, Artificial
  IGFBP-2 heparin binding domain-containing peptide sequence
RKKIGVNEPKK

SEQ ID NO: 451 - protein, 11 aa, Artificial
  IGFBP-2 heparin binding domain-containing peptide sequence
HKKIGVNEPKK

SEQ ID NO: 452 - protein, 11 aa, Artificial
  IGFBP-2 heparin binding domain-containing peptide sequence
KRKIGVNEPKK

SEQ ID NO: 453 - protein, 11 aa, Artificial
  IGFBP-2 heparin binding domain-containing peptide sequence
RRKIGVNEPKK

SEQ ID NO: 454 - protein, 11 aa, Artificial
  IGFBP-2 heparin binding domain-containing peptide sequence
HRKIGVNEPKK

SEQ ID NO: 455 - protein, 11 aa, Artificial
  IGFBP-2 heparin binding domain-containing peptide sequence
KHRIGVNEPKK

SEQ ID NO: 456 - protein, 11 aa, Artificial
  IGFBP-2 heparin binding domain-containing peptide sequence
RHRIGVNEPKK

SEQ ID NO: 457 - protein, 11 aa, Artificial
  IGFBP-2 heparin binding domain-containing peptide sequence
HHRIGVNEPKK

SEQ ID NO: 458 - protein, 11 aa, Artificial
  IGFBP-2 heparin binding domain-containing peptide sequence
KKRIGVNEPKK

SEQ ID NO: 459 - protein, 11 aa, Artificial
  IGFBP-2 heparin binding domain-containing peptide sequence
RKRIGVNEPKK

SEQ ID NO: 460 - protein, 11 aa, Artificial
  IGFBP-2 heparin binding domain-containing peptide sequence
HKRIGVNEPKK

SEQ ID NO: 461 - protein, 11 aa, Artificial
  IGFBP-2 heparin binding domain-containing peptide sequence
KRRIGVNEPKK

SEQ ID NO: 462 - protein, 11 aa, Artificial
  IGFBP-2 heparin binding domain-containing peptide sequence
RRRIGVNEPKK

SEQ ID NO: 463 - protein, 11 aa, Artificial
  IGFBP-2 heparin binding domain-containing peptide sequence
HRRIGVNEPKK

SEQ ID NO: 464 - protein, 11 aa, Artificial
  IGFBP-2 heparin binding domain-containing peptide sequence
KHHVGVNEPKK

SEQ ID NO: 465 - protein, 11 aa, Artificial
  IGFBP-2 heparin binding domain-containing peptide sequence
RHHVGVNEPKK

SEQ ID NO: 466 - protein, 11 aa, Artificial
  IGFBP-2 heparin binding domain-containing peptide sequence
HHHVGVNEPKK

SEQ ID NO: 467 - protein, 11 aa, Artificial
  IGFBP-2 heparin binding domain-containing peptide sequence
KKHVGVNEPKK

SEQ ID NO: 468 - protein, 11 aa, Artificial
  IGFBP-2 heparin binding domain-containing peptide sequence
RKHVGVNEPKK

SEQ ID NO: 469 - protein, 11 aa, Artificial
  IGFBP-2 heparin binding domain-containing peptide sequence
HKHVGVNEPKK

SEQ ID NO: 470 - protein, 11 aa, Artificial
  IGFBP-2 heparin binding domain-containing peptide sequence
KRHVGVNEPKK

SEQ ID NO: 471 - protein, 11 aa, Artificial
  IGFBP-2 heparin binding domain-containing peptide sequence
RRHVGVNEPKK

SEQ ID NO: 472 - protein, 11 aa, Artificial
  IGFBP-2 heparin binding domain-containing peptide sequence
HRHVGVNEPKK

SEQ ID NO: 473 - protein, 11 aa, Artificial
  IGFBP-2 heparin binding domain-containing peptide sequence
KHKVGVNEPKK

SEQ ID NO: 474 - protein, 11 aa, Artificial
  IGFBP-2 heparin binding domain-containing peptide sequence
RHKVGVNEPKK

SEQ ID NO: 475 - protein, 11 aa, Artificial
  IGFBP-2 heparin binding domain-containing peptide sequence
HHKVGVNEPKK

SEQ ID NO: 476 - protein, 11 aa, Artificial
  IGFBP-2 heparin binding domain-containing peptide sequence
KKKVGVNEPKK

SEQ ID NO: 477 - protein, 11 aa, Artificial
  IGFBP-2 heparin binding domain-containing peptide sequence
RKKVGVNEPKK

SEQ ID NO: 478 - protein, 11 aa, Artificial
  IGFBP-2 heparin binding domain-containing peptide sequence
HKKVGVNEPKK

SEQ ID NO: 479 - protein, 11 aa, Artificial
  IGFBP-2 heparin binding domain-containing peptide sequence
KRKVGVNEPKK

SEQ ID NO: 480 - protein, 11 aa, Artificial
  IGFBP-2 heparin binding domain-containing peptide sequence
RRKVGVNEPKK

SEQ ID NO: 481 - protein, 11 aa, Artificial
  IGFBP-2 heparin binding domain-containing peptide sequence
HRKVGVNEPKK

SEQ ID NO: 482 - protein, 11 aa, Artificial
  IGFBP-2 heparin binding domain-containing peptide sequence
KHRVGVNEPKK

SEQ ID NO: 483 - protein, 11 aa, Artificial
  IGFBP-2 heparin binding domain-containing peptide sequence
RHRVGVNEPKK

SEQ ID NO: 484 - protein, 11 aa, Artificial
  IGFBP-2 heparin binding domain-containing peptide sequence
HHRVGVNEPKK

SEQ ID NO: 485 - protein, 11 aa, Artificial
  IGFBP-2 heparin binding domain-containing peptide sequence
KKRVGVNEPKK

SEQ ID NO: 486 - protein, 11 aa, Artificial
  IGFBP-2 heparin binding domain-containing peptide sequence
RKRVGVNEPKK

SEQ ID NO: 487 - protein, 11 aa, Artificial
  IGFBP-2 heparin binding domain-containing peptide sequence
HKRVGVNEPKK

SEQ ID NO: 488 - protein, 11 aa, Artificial
  IGFBP-2 heparin binding domain-containing peptide sequence
KRRVGVNEPKK

SEQ ID NO: 489 - protein, 11 aa, Artificial
  IGFBP-2 heparin binding domain-containing peptide sequence
RRRVGVNEPKK

SEQ ID NO: 490 - protein, 11 aa, Artificial
  IGFBP-2 heparin binding domain-containing peptide sequence
HRRVGVNEPKK

SEQ ID NO: 491 - protein, 11 aa, Artificial
  IGFBP-2 heparin binding domain-containing peptide sequence
KHHLGLENPKK

SEQ ID NO: 492 - protein, 11 aa, Artificial
  IGFBP-2 heparin binding domain-containing peptide sequence
RHHLGLENPKK

SEQ ID NO: 493 - protein, 11 aa, Artificial
  IGFBP-2 heparin binding domain-containing peptide sequence
HHHLGLENPKK

SEQ ID NO: 494 - protein, 11 aa, Artificial
  IGFBP-2 heparin binding domain-containing peptide sequence
KKHLGLENPKK

SEQ ID NO: 495 - protein, 11 aa, Artificial
  IGFBP-2 heparin binding domain-containing peptide sequence
RKHLGLENPKK

SEQ ID NO: 496 - protein, 11 aa, Artificial
  IGFBP-2 heparin binding domain-containing peptide sequence
HKHLGLENPKK

SEQ ID NO: 497 - protein, 11 aa, Artificial
  IGFBP-2 heparin binding domain-containing peptide sequence
KRHLGLENPKK

SEQ ID NO: 498 - protein, 11 aa, Artificial
  IGFBP-2 heparin binding domain-containing peptide sequence
RRHLGLENPKK

SEQ ID NO: 499 - protein, 11 aa, Artificial
  IGFBP-2 heparin binding domain-containing peptide sequence
HRHLGLENPKK

SEQ ID NO: 500 - protein, 11 aa, Artificial
  IGFBP-2 heparin binding domain-containing peptide sequence
KHKLGLENPKK

SEQ ID NO: 501 - protein, 11 aa, Artificial
  IGFBP-2 heparin binding domain-containing peptide sequence
RHKLGLENPKK

SEQ ID NO: 502 - protein, 11 aa, Artificial
  IGFBP-2 heparin binding domain-containing peptide sequence
HHKLGLENPKK

SEQ ID NO: 503 - protein, 11 aa, Artificial
  IGFBP-2 heparin binding domain-containing peptide sequence
KKKLGLENPKK

SEQ ID NO: 504 - protein, 11 aa, Artificial
  IGFBP-2 heparin binding domain-containing peptide sequence
RKKLGLENPKK

SEQ ID NO: 505 - protein, 11 aa, Artificial
  IGFBP-2 heparin binding domain-containing peptide sequence
HKKLGLENPKK

SEQ ID NO: 506 - protein, 11 aa, Artificial
  IGFBP-2 heparin binding domain-containing peptide sequence
KRKLGLENPKK

SEQ ID NO: 507 - protein, 11 aa, Artificial
  IGFBP-2 heparin binding domain-containing peptide sequence
RRKLGLENPKK

SEQ ID NO: 508 - protein, 11 aa, Artificial
  IGFBP-2 heparin binding domain-containing peptide sequence
HRKLGLENPKK

SEQ ID NO: 509 - protein, 11 aa, Artificial
  IGFBP-2 heparin binding domain-containing peptide sequence
KHRLGLENPKK

SEQ ID NO: 510 - protein, 11 aa, Artificial
  IGFBP-2 heparin binding domain-containing peptide sequence
RHRLGLENPKK

SEQ ID NO: 511 - protein, 11 aa, Artificial
  IGFBP-2 heparin binding domain-containing peptide sequence
HHRLGLENPKK

SEQ ID NO: 512 - protein, 11 aa, Artificial
  IGFBP-2 heparin binding domain-containing peptide sequence
KKRLGLENPKK

SEQ ID NO: 513 - protein, 11 aa, Artificial
  IGFBP-2 heparin binding domain-containing peptide sequence
RKRLGLENPKK

SEQ ID NO: 514 - protein, 11 aa, Artificial
  IGFBP-2 heparin binding domain-containing peptide sequence
HKRLGLENPKK

SEQ ID NO: 515 - protein, 11 aa, Artificial
  IGFBP-2 heparin binding domain-containing peptide sequence
KRRLGLENPKK

SEQ ID NO: 516 - protein, 11 aa, Artificial
  IGFBP-2 heparin binding domain-containing peptide sequence
RRRLGLENPKK

SEQ ID NO: 517 - protein, 11 aa, Artificial
  IGFBP-2 heparin binding domain-containing peptide sequence
HRRLGLENPKK

SEQ ID NO: 518 - protein, 11 aa, Artificial
  IGFBP-2 heparin binding domain-containing peptide sequence
KHHIGLENPKK

SEQ ID NO: 519 - protein, 11 aa, Artificial
  IGFBP-2 heparin binding domain-containing peptide sequence
RHHIGLENPKK

SEQ ID NO: 520 - protein, 11 aa, Artificial
  IGFBP-2 heparin binding domain-containing peptide sequence
HHHIGLENPKK

SEQ ID NO: 521 - protein, 11 aa, Artificial
  IGFBP-2 heparin binding domain-containing peptide sequence
KKHIGLENPKK

SEQ ID NO: 522 - protein, 11 aa, Artificial
  IGFBP-2 heparin binding domain-containing peptide sequence
RKHIGLENPKK

SEQ ID NO: 523 - protein, 11 aa, Artificial
  IGFBP-2 heparin binding domain-containing peptide sequence
HKHIGLENPKK

SEQ ID NO: 524 - protein, 11 aa, Artificial
  IGFBP-2 heparin binding domain-containing peptide sequence
KRHIGLENPKK

SEQ ID NO: 525 - protein, 11 aa, Artificial
  IGFBP-2 heparin binding domain-containing peptide sequence
RRHIGLENPKK

SEQ ID NO: 526 - protein, 11 aa, Artificial
  IGFBP-2 heparin binding domain-containing peptide sequence
HRHIGLENPKK

SEQ ID NO: 527 - protein, 11 aa, Artificial
  IGFBP-2 heparin binding domain-containing peptide sequence
KHKIGLENPKK

SEQ ID NO: 528 - protein, 11 aa, Artificial
  IGFBP-2 heparin binding domain-containing peptide sequence
RHKIGLENPKK

SEQ ID NO: 529 - protein, 11 aa, Artificial
  IGFBP-2 heparin binding domain-containing peptide sequence
HHKIGLENPKK

SEQ ID NO: 530 - protein, 11 aa, Artificial
  IGFBP-2 heparin binding domain-containing peptide sequence
KKKIGLENPKK

SEQ ID NO: 531 - protein, 11 aa, Artificial
  IGFBP-2 heparin binding domain-containing peptide sequence
RKKIGLENPKK

SEQ ID NO: 532 - protein, 11 aa, Artificial
  IGFBP-2 heparin binding domain-containing peptide sequence
HKKIGLENPKK

SEQ ID NO: 533 - protein, 11 aa, Artificial
  IGFBP-2 heparin binding domain-containing peptide sequence
KRKIGLENPKK

SEQ ID NO: 534 - protein, 11 aa, Artificial
  IGFBP-2 heparin binding domain-containing peptide sequence
RRKIGLENPKK

SEQ ID NO: 535 - protein, 11 aa, Artificial
  IGFBP-2 heparin binding domain-containing peptide sequence
HRKIGLENPKK

SEQ ID NO: 536 - protein, 11 aa, Artificial
  IGFBP-2 heparin binding domain-containing peptide sequence
KHRIGLENPKK

SEQ ID NO: 537 - protein, 11 aa, Artificial
  IGFBP-2 heparin binding domain-containing peptide sequence
RHRIGLENPKK

SEQ ID NO: 538 - protein, 11 aa, Artificial
  IGFBP-2 heparin binding domain-containing peptide sequence
HHRIGLENPKK

SEQ ID NO: 539 - protein, 11 aa, Artificial
  IGFBP-2 heparin binding domain-containing peptide sequence
KKRIGLENPKK

SEQ ID NO: 540 - protein, 11 aa, Artificial
  IGFBP-2 heparin binding domain-containing peptide sequence
RKRIGLENPKK

SEQ ID NO: 541 - protein, 11 aa, Artificial
  IGFBP-2 heparin binding domain-containing peptide sequence
HKRIGLENPKK

SEQ ID NO: 542 - protein, 11 aa, Artificial
  IGFBP-2 heparin binding domain-containing peptide sequence
KRRIGLENPKK

SEQ ID NO: 543 - protein, 11 aa, Artificial
  IGFBP-2 heparin binding domain-containing peptide sequence
RRRIGLENPKK

SEQ ID NO: 544 - protein, 11 aa, Artificial
  IGFBP-2 heparin binding domain-containing peptide sequence
HRRIGLENPKK

SEQ ID NO: 545 - protein, 11 aa, Artificial
  IGFBP-2 heparin binding domain-containing peptide sequence
KHHVGLENPKK

SEQ ID NO: 546 - protein, 11 aa, Artificial
  IGFBP-2 heparin binding domain-containing peptide sequence
RHHVGLENPKK

SEQ ID NO: 547 - protein, 11 aa, Artificial
  IGFBP-2 heparin binding domain-containing peptide sequence
HHHVGLENPKK

SEQ ID NO: 548 - protein, 11 aa, Artificial
  IGFBP-2 heparin binding domain-containing peptide sequence
KKHVGLENPKK

SEQ ID NO: 549 - protein, 11 aa, Artificial
  IGFBP-2 heparin binding domain-containing peptide sequence
RKHVGLENPKK

SEQ ID NO: 550 - protein, 11 aa, Artificial
  IGFBP-2 heparin binding domain-containing peptide sequence
HKHVGLENPKK

SEQ ID NO: 551 - protein, 11 aa, Artificial
  IGFBP-2 heparin binding domain-containing peptide sequence
KRHVGLENPKK

SEQ ID NO: 552 - protein, 11 aa, Artificial
  IGFBP-2 heparin binding domain-containing peptide sequence
RRHVGLENPKK

SEQ ID NO: 553 - protein, 11 aa, Artificial
  IGFBP-2 heparin binding domain-containing peptide sequence
HRHVGLENPKK

SEQ ID NO: 554 - protein, 11 aa, Artificial
  IGFBP-2 heparin binding domain-containing peptide sequence
KHKVGLENPKK

SEQ ID NO: 555 - protein, 11 aa, Artificial
  IGFBP-2 heparin binding domain-containing peptide sequence
RHKVGLENPKK

SEQ ID NO: 556 - protein, 11 aa, Artificial
  IGFBP-2 heparin binding domain-containing peptide sequence
HHKVGLENPKK

SEQ ID NO: 557 - protein, 11 aa, Artificial
  IGFBP-2 heparin binding domain-containing peptide sequence
KKKVGLENPKK

SEQ ID NO: 558 - protein, 11 aa, Artificial
  IGFBP-2 heparin binding domain-containing peptide sequence
RKKVGLENPKK

SEQ ID NO: 559 - protein, 11 aa, Artificial
  IGFBP-2 heparin binding domain-containing peptide sequence
HKKVGLENPKK

SEQ ID NO: 560 - protein, 11 aa, Artificial
  IGFBP-2 heparin binding domain-containing peptide sequence
KRKVGLENPKK

SEQ ID NO: 561 - protein, 11 aa, Artificial
  IGFBP-2 heparin binding domain-containing peptide sequence
RRKVGLENPKK

SEQ ID NO: 562 - protein, 11 aa, Artificial
  IGFBP-2 heparin binding domain-containing peptide sequence
HRKVGLENPKK

SEQ ID NO: 563 - protein, 11 aa, Artificial
  IGFBP-2 heparin binding domain-containing peptide sequence
KHRVGLENPKK

SEQ ID NO: 564 - protein, 11 aa, Artificial
  IGFBP-2 heparin binding domain-containing peptide sequence
RHRVGLENPKK

SEQ ID NO: 565 - protein, 11 aa, Artificial
  IGFBP-2 heparin binding domain-containing peptide sequence
HHRVGLENPKK

SEQ ID NO: 566 - protein, 11 aa, Artificial
  IGFBP-2 heparin binding domain-containing peptide sequence
KKRVGLENPKK

SEQ ID NO: 567 - protein, 11 aa, Artificial
  IGFBP-2 heparin binding domain-containing peptide sequence
RKRVGLENPKK

SEQ ID NO: 568 - protein, 11 aa, Artificial
  IGFBP-2 heparin binding domain-containing peptide sequence
HKRVGLENPKK

SEQ ID NO: 569 - protein, 11 aa, Artificial
  IGFBP-2 heparin binding domain-containing peptide sequence
KRRVGLENPKK

SEQ ID NO: 570 - protein, 11 aa, Artificial
  IGFBP-2 heparin binding domain-containing peptide sequence
RRRVGLENPKK

SEQ ID NO: 571 - protein, 11 aa, Artificial
  IGFBP-2 heparin binding domain-containing peptide sequence
HRRVGLENPKK

SEQ ID NO: 572 - protein, 11 aa, Artificial
  IGFBP-2 heparin binding domain-containing peptide sequence
KHHLGIENPKK

SEQ ID NO: 573 - protein, 11 aa, Artificial
  IGFBP-2 heparin binding domain-containing peptide sequence
RHHLGIENPKK

SEQ ID NO: 574 - protein, 11 aa, Artificial
  IGFBP-2 heparin binding domain-containing peptide sequence
HHHLGIENPKK

SEQ ID NO: 575 - protein, 11 aa, Artificial
  IGFBP-2 heparin binding domain-containing peptide sequence
KKHLGIENPKK

SEQ ID NO: 576 - protein, 11 aa, Artificial
  IGFBP-2 heparin binding domain-containing peptide sequence
RKHLGIENPKK

SEQ ID NO: 577 - protein, 11 aa, Artificial
  IGFBP-2 heparin binding domain-containing peptide sequence
HKHLGIENPKK

SEQ ID NO: 578 - protein, 11 aa, Artificial
  IGFBP-2 heparin binding domain-containing peptide sequence
KRHLGIENPKK

SEQ ID NO: 579 - protein, 11 aa, Artificial
  IGFBP-2 heparin binding domain-containing peptide sequence
RRHLGIENPKK

SEQ ID NO: 580 - protein, 11 aa, Artificial
  IGFBP-2 heparin binding domain-containing peptide sequence
HRHLGIENPKK

SEQ ID NO: 581 - protein, 11 aa, Artificial
  IGFBP-2 heparin binding domain-containing peptide sequence
KHKLGIENPKK

SEQ ID NO: 582 - protein, 11 aa, Artificial
  IGFBP-2 heparin binding domain-containing peptide sequence
RHKLGIENPKK

SEQ ID NO: 583 - protein, 11 aa, Artificial
  IGFBP-2 heparin binding domain-containing peptide sequence
HHKLGIENPKK

SEQ ID NO: 584 - protein, 11 aa, Artificial
  IGFBP-2 heparin binding domain-containing peptide sequence
KKKLGIENPKK

SEQ ID NO: 585 - protein, 11 aa, Artificial
  IGFBP-2 heparin binding domain-containing peptide sequence
RKKLGIENPKK

SEQ ID NO: 586 - protein, 11 aa, Artificial
  IGFBP-2 heparin binding domain-containing peptide sequence
HKKLGIENPKK

SEQ ID NO: 587 - protein, 11 aa, Artificial
  IGFBP-2 heparin binding domain-containing peptide sequence
KRKLGIENPKK

SEQ ID NO: 588 - protein, 11 aa, Artificial
  IGFBP-2 heparin binding domain-containing peptide sequence
RRKLGIENPKK

SEQ ID NO: 589 - protein, 11 aa, Artificial
  IGFBP-2 heparin binding domain-containing peptide sequence
HRKLGIENPKK

SEQ ID NO: 590 - protein, 11 aa, Artificial
  IGFBP-2 heparin binding domain-containing peptide sequence
KHRLGIENPKK

SEQ ID NO: 591 - protein, 11 aa, Artificial
  IGFBP-2 heparin binding domain-containing peptide sequence
RHRLGIENPKK

SEQ ID NO: 592 - protein, 11 aa, Artificial
  IGFBP-2 heparin binding domain-containing peptide sequence
HHRLGIENPKK

SEQ ID NO: 593 - protein, 11 aa, Artificial
  IGFBP-2 heparin binding domain-containing peptide sequence
KKRLGIENPKK

SEQ ID NO: 594 - protein, 11 aa, Artificial
  IGFBP-2 heparin binding domain-containing peptide sequence
RKRLGIENPKK

SEQ ID NO: 595 - protein, 11 aa, Artificial
  IGFBP-2 heparin binding domain-containing peptide sequence
HKRLGIENPKK

SEQ ID NO: 596 - protein, 11 aa, Artificial
  IGFBP-2 heparin binding domain-containing peptide sequence
KRRLGIENPKK

SEQ ID NO: 597 - protein, 11 aa, Artificial
  IGFBP-2 heparin binding domain-containing peptide sequence
RRRLGIENPKK

SEQ ID NO: 598 - protein, 11 aa, Artificial
  IGFBP-2 heparin binding domain-containing peptide sequence
HRRLGIENPKK

SEQ ID NO: 599 - protein, 11 aa, Artificial
  IGFBP-2 heparin binding domain-containing peptide sequence
KHHIGIENPKK

SEQ ID NO: 600 - protein, 11 aa, Artificial
  IGFBP-2 heparin binding domain-containing peptide sequence
RHHIGIENPKK

SEQ ID NO: 601 - protein, 11 aa, Artificial
  IGFBP-2 heparin binding domain-containing peptide sequence
HHHIGIENPKK

SEQ ID NO: 602 - protein, 11 aa, Artificial
  IGFBP-2 heparin binding domain-containing peptide sequence
KKHIGIENPKK

SEQ ID NO: 603 - protein, 11 aa, Artificial
  IGFBP-2 heparin binding domain-containing peptide sequence
RKHIGIENPKK

SEQ ID NO: 604 - protein, 11 aa, Artificial
  IGFBP-2 heparin binding domain-containing peptide sequence
HKHIGIENPKK

SEQ ID NO: 605 - protein, 11 aa, Artificial
  IGFBP-2 heparin binding domain-containing peptide sequence
KRHIGIENPKK

SEQ ID NO: 606 - protein, 11 aa, Artificial
  IGFBP-2 heparin binding domain-containing peptide sequence
RRHIGIENPKK

SEQ ID NO: 607 - protein, 11 aa, Artificial
  IGFBP-2 heparin binding domain-containing peptide sequence
HRHIGIENPKK

SEQ ID NO: 608 - protein, 11 aa, Artificial
  IGFBP-2 heparin binding domain-containing peptide sequence
KHKIGIENPKK

SEQ ID NO: 609 - protein, 11 aa, Artificial
  IGFBP-2 heparin binding domain-containing peptide sequence
RHKIGIENPKK

SEQ ID NO: 610 - protein, 11 aa, Artificial
  IGFBP-2 heparin binding domain-containing peptide sequence
HHKIGIENPKK

SEQ ID NO: 611 - protein, 11 aa, Artificial
  IGFBP-2 heparin binding domain-containing peptide sequence
KKKIGIENPKK

SEQ ID NO: 612 - protein, 11 aa, Artificial
  IGFBP-2 heparin binding domain-containing peptide sequence
RKKIGIENPKK

SEQ ID NO: 613 - protein, 11 aa, Artificial
  IGFBP-2 heparin binding domain-containing peptide sequence
HKKIGIENPKK

SEQ ID NO: 614 - protein, 11 aa, Artificial
  IGFBP-2 heparin binding domain-containing peptide sequence
KRKIGIENPKK

SEQ ID NO: 615 - protein, 11 aa, Artificial
  IGFBP-2 heparin binding domain-containing peptide sequence
RRKIGIENPKK

SEQ ID NO: 616 - protein, 11 aa, Artificial
  IGFBP-2 heparin binding domain-containing peptide sequence
HRKIGIENPKK

SEQ ID NO: 617 - protein, 11 aa, Artificial
  IGFBP-2 heparin binding domain-containing peptide sequence
KHRIGIENPKK

SEQ ID NO: 618 - protein, 11 aa, Artificial
  IGFBP-2 heparin binding domain-containing peptide sequence
RHRIGIENPKK

SEQ ID NO: 619 - protein, 11 aa, Artificial
  IGFBP-2 heparin binding domain-containing peptide sequence
HHRIGIENPKK

SEQ ID NO: 620 - protein, 11 aa, Artificial
  IGFBP-2 heparin binding domain-containing peptide sequence
KKRIGIENPKK

SEQ ID NO: 621 - protein, 11 aa, Artificial
  IGFBP-2 heparin binding domain-containing peptide sequence
RKRIGIENPKK

SEQ ID NO: 622 - protein, 11 aa, Artificial
  IGFBP-2 heparin binding domain-containing peptide sequence
HKRIGIENPKK

SEQ ID NO: 623 - protein, 11 aa, Artificial
  IGFBP-2 heparin binding domain-containing peptide sequence
KRRIGIENPKK

SEQ ID NO: 624 - protein, 11 aa, Artificial
  IGFBP-2 heparin binding domain-containing peptide sequence
RRRIGIENPKK

SEQ ID NO: 625 - protein, 11 aa, Artificial
  IGFBP-2 heparin binding domain-containing peptide sequence
HRRIGIENPKK

SEQ ID NO: 626 - protein, 11 aa, Artificial
  IGFBP-2 heparin binding domain-containing peptide sequence
KHHVGIENPKK

SEQ ID NO: 627 - protein, 11 aa, Artificial
  IGFBP-2 heparin binding domain-containing peptide sequence
RHHVGIENPKK

SEQ ID NO: 628 - protein, 11 aa, Artificial
  IGFBP-2 heparin binding domain-containing peptide sequence
HHHVGIENPKK

SEQ ID NO: 629 - protein, 11 aa, Artificial
  IGFBP-2 heparin binding domain-containing peptide sequence
KKHVGIENPKK

SEQ ID NO: 630 - protein, 11 aa, Artificial
  IGFBP-2 heparin binding domain-containing peptide sequence
RKHVGIENPKK

SEQ ID NO: 631 - protein, 11 aa, Artificial
  IGFBP-2 heparin binding domain-containing peptide sequence
HKHVGIENPKK

SEQ ID NO: 632 - protein, 11 aa, Artificial
  IGFBP-2 heparin binding domain-containing peptide sequence
KRHVGIENPKK

SEQ ID NO: 633 - protein, 11 aa, Artificial
  IGFBP-2 heparin binding domain-containing peptide sequence
RRHVGIENPKK

SEQ ID NO: 634 - protein, 11 aa, Artificial
  IGFBP-2 heparin binding domain-containing peptide sequence
HRHVGIENPKK

SEQ ID NO: 635 - protein, 11 aa, Artificial
  IGFBP-2 heparin binding domain-containing peptide sequence
KHKVGIENPKK

SEQ ID NO: 636 - protein, 11 aa, Artificial
  IGFBP-2 heparin binding domain-containing peptide sequence
RHKVGIENPKK

SEQ ID NO: 637 - protein, 11 aa, Artificial
  IGFBP-2 heparin binding domain-containing peptide sequence
HHKVGIENPKK

SEQ ID NO: 638 - protein, 11 aa, Artificial
  IGFBP-2 heparin binding domain-containing peptide sequence
KKKVGIENPKK

SEQ ID NO: 639 - protein, 11 aa, Artificial
  IGFBP-2 heparin binding domain-containing peptide sequence
RKKVGIENPKK

SEQ ID NO: 640 - protein, 11 aa, Artificial
  IGFBP-2 heparin binding domain-containing peptide sequence
HKKVGIENPKK

SEQ ID NO: 641 - protein, 11 aa, Artificial
  IGFBP-2 heparin binding domain-containing peptide sequence
KRKVGIENPKK

SEQ ID NO: 642 - protein, 11 aa, Artificial
  IGFBP-2 heparin binding domain-containing peptide sequence
RRKVGIENPKK

SEQ ID NO: 643 - protein, 11 aa, Artificial
  IGFBP-2 heparin binding domain-containing peptide sequence
HRKVGIENPKK

SEQ ID NO: 644 - protein, 11 aa, Artificial
  IGFBP-2 heparin binding domain-containing peptide sequence
KHRVGIENPKK

SEQ ID NO: 645 - protein, 11 aa, Artificial
  IGFBP-2 heparin binding domain-containing peptide sequence
RHRVGIENPKK

SEQ ID NO: 646 - protein, 11 aa, Artificial
  IGFBP-2 heparin binding domain-containing peptide sequence
HHRVGIENPKK

SEQ ID NO: 647 - protein, 11 aa, Artificial
  IGFBP-2 heparin binding domain-containing peptide sequence
KKRVGIENPKK

SEQ ID NO: 648 - protein, 11 aa, Artificial
  IGFBP-2 heparin binding domain-containing peptide sequence
RKRVGIENPKK

SEQ ID NO: 649 - protein, 11 aa, Artificial
  IGFBP-2 heparin binding domain-containing peptide sequence
HKRVGIENPKK

SEQ ID NO: 650 - protein, 11 aa, Artificial
  IGFBP-2 heparin binding domain-containing peptide sequence
KRRVGIENPKK

SEQ ID NO: 651 - protein, 11 aa, Artificial
  IGFBP-2 heparin binding domain-containing peptide sequence
RRRVGIENPKK

SEQ ID NO: 652 - protein, 11 aa, Artificial
  IGFBP-2 heparin binding domain-containing peptide sequence
HRRVGIENPKK

SEQ ID NO: 653 - protein, 11 aa, Artificial
  IGFBP-2 heparin binding domain-containing peptide sequence
KHHLGVENPKK

SEQ ID NO: 654 - protein, 11 aa, Artificial
  IGFBP-2 heparin binding domain-containing peptide sequence
RHHLGVENPKK

SEQ ID NO: 655 - protein, 11 aa, Artificial
  IGFBP-2 heparin binding domain-containing peptide sequence
HHHLGVENPKK

SEQ ID NO: 656 - protein, 11 aa, Artificial
  IGFBP-2 heparin binding domain-containing peptide sequence
KKHLGVENPKK

SEQ ID NO: 657 - protein, 11 aa, Artificial
  IGFBP-2 heparin binding domain-containing peptide sequence
RKHLGVENPKK

SEQ ID NO: 658 - protein, 11 aa, Artificial
  IGFBP-2 heparin binding domain-containing peptide sequence
HKHLGVENPKK

SEQ ID NO: 659 - protein, 11 aa, Artificial
  IGFBP-2 heparin binding domain-containing peptide sequence
KRHLGVENPKK

SEQ ID NO: 660 - protein, 11 aa, Artificial
  IGFBP-2 heparin binding domain-containing peptide sequence
RRHLGVENPKK

SEQ ID NO: 661 - protein, 11 aa, Artificial
  IGFBP-2 heparin binding domain-containing peptide sequence
HRHLGVENPKK

SEQ ID NO: 662 - protein, 11 aa, Artificial
  IGFBP-2 heparin binding domain-containing peptide sequence
KHKLGVENPKK

SEQ ID NO: 663 - protein, 11 aa, Artificial
  IGFBP-2 heparin binding domain-containing peptide sequence
RHKLGVENPKK

SEQ ID NO: 664 - protein, 11 aa, Artificial
  IGFBP-2 heparin binding domain-containing peptide sequence
HHKLGVENPKK

SEQ ID NO: 665 - protein, 11 aa, Artificial
  IGFBP-2 heparin binding domain-containing peptide sequence
KKKLGVENPKK

SEQ ID NO: 666 - protein, 11 aa, Artificial
  IGFBP-2 heparin binding domain-containing peptide sequence
RKKLGVENPKK

SEQ ID NO: 667 - protein, 11 aa, Artificial
  IGFBP-2 heparin binding domain-containing peptide sequence
HKKLGVENPKK

SEQ ID NO: 668 - protein, 11 aa, Artificial
  IGFBP-2 heparin binding domain-containing peptide sequence
KRKLGVENPKK

SEQ ID NO: 669 - protein, 11 aa, Artificial
  IGFBP-2 heparin binding domain-containing peptide sequence
RRKLGVENPKK

SEQ ID NO: 670 - protein, 11 aa, Artificial
  IGFBP-2 heparin binding domain-containing peptide sequence
HRKLGVENPKK

SEQ ID NO: 671 - protein, 11 aa, Artificial
  IGFBP-2 heparin binding domain-containing peptide sequence
KHRLGVENPKK

SEQ ID NO: 672 - protein, 11 aa, Artificial
  IGFBP-2 heparin binding domain-containing peptide sequence
RHRLGVENPKK

SEQ ID NO: 673 - protein, 11 aa, Artificial
  IGFBP-2 heparin binding domain-containing peptide sequence
HHRLGVENPKK

SEQ ID NO: 674 - protein, 11 aa, Artificial
  IGFBP-2 heparin binding domain-containing peptide sequence
KKRLGVENPKK

SEQ ID NO: 675 - protein, 11 aa, Artificial
  IGFBP-2 heparin binding domain-containing peptide sequence
RKRLGVENPKK

SEQ ID NO: 676 - protein, 11 aa, Artificial
  IGFBP-2 heparin binding domain-containing peptide sequence
HKRLGVENPKK

SEQ ID NO: 677 - protein, 11 aa, Artificial
  IGFBP-2 heparin binding domain-containing peptide sequence
KRRLGVENPKK

SEQ ID NO: 678 - protein, 11 aa, Artificial
  IGFBP-2 heparin binding domain-containing peptide sequence
RRRLGVENPKK

SEQ ID NO: 679 - protein, 11 aa, Artificial
  IGFBP-2 heparin binding domain-containing peptide sequence
HRRLGVENPKK

SEQ ID NO: 680 - protein, 11 aa, Artificial
  IGFBP-2 heparin binding domain-containing peptide sequence
KHHIGVENPKK

SEQ ID NO: 681 - protein, 11 aa, Artificial
  IGFBP-2 heparin binding domain-containing peptide sequence
RHHIGVEEPKK

SEQ ID NO: 682 - protein, 11 aa, Artificial
  IGFBP-2 heparin binding domain-containing peptide sequence
HHHIGVENPKK

SEQ ID NO: 683 - protein, 11 aa, Artificial
  IGFBP-2 heparin binding domain-containing peptide sequence
KKHIGVENPKK

SEQ ID NO: 684 - protein, 11 aa, Artificial
  IGFBP-2 heparin binding domain-containing peptide sequence
RKHIGVENPKK

SEQ ID NO: 685 - protein, 11 aa, Artificial
  IGFBP-2 heparin binding domain-containing peptide sequence
HKHIGVENPKK

SEQ ID NO: 686 - protein, 11 aa, Artificial
  IGFBP-2 heparin binding domain-containing peptide sequence
KRHIGVENPKK

SEQ ID NO: 687 - protein, 11 aa, Artificial
  IGFBP-2 heparin binding domain-containing peptide sequence
RRHIGVENPKK

SEQ ID NO: 688 - protein, 11 aa, Artificial
  IGFBP-2 heparin binding domain-containing peptide sequence
HRHIGVENPKK

SEQ ID NO: 689 - protein, 11 aa, Artificial
  IGFBP-2 heparin binding domain-containing peptide sequence
KHKIGVENPKK

SEQ ID NO: 690 - protein, 11 aa, Artificial
  IGFBP-2 heparin binding domain-containing peptide sequence
RHKIGVENPKK

SEQ ID NO: 691 - protein, 11 aa, Artificial
  IGFBP-2 heparin binding domain-containing peptide sequence
HHKIGVENPKK

SEQ ID NO: 692 - protein, 11 aa, Artificial
  IGFBP-2 heparin binding domain-containing peptide sequence
KKKIGVENPKK

SEQ ID NO: 693 - protein, 11 aa, Artificial
  IGFBP-2 heparin binding domain-containing peptide sequence
RKKIGVENPKK

SEQ ID NO: 694 - protein, 11 aa, Artificial
  IGFBP-2 heparin binding domain-containing peptide sequence
HKKIGVENPKK

SEQ ID NO: 695 - protein, 11 aa, Artificial
  IGFBP-2 heparin binding domain-containing peptide sequence
KRKIGVENPKK

SEQ ID NO: 696 - protein, 11 aa, Artificial
  IGFBP-2 heparin binding domain-containing peptide sequence
RRKIGVENPKK

SEQ ID NO: 697 - protein, 11 aa, Artificial
  IGFBP-2 heparin binding domain-containing peptide sequence
HRKIGVENPKK

SEQ ID NO: 698 - protein, 11 aa, Artificial
  IGFBP-2 heparin binding domain-containing peptide sequence
KHRIGVENPKK

SEQ ID NO: 699 - protein, 11 aa, Artificial
  IGFBP-2 heparin binding domain-containing peptide sequence
RHRIGVENPKK

SEQ ID NO: 700 - protein, 11 aa, Artificial
  IGFBP-2 heparin binding domain-containing peptide sequence
HHRIGVENPKK

SEQ ID NO: 701 - protein, 11 aa, Artificial
  IGFBP-2 heparin binding domain-containing peptide sequence
KKRIGVENPKK

SEQ ID NO: 702 - protein, 11 aa, Artificial
  IGFBP-2 heparin binding domain-containing peptide sequence
RKRIGVENPKK

SEQ ID NO: 703 - protein, 11 aa, Artificial
  IGFBP-2 heparin binding domain-containing peptide sequence
HKRIGVENPKK

SEQ ID NO: 704 - protein, 11 aa, Artificial
  IGFBP-2 heparin binding domain-containing peptide sequence
KRRIGVENPKK

SEQ ID NO: 705 - protein, 11 aa, Artificial
  IGFBP-2 heparin binding domain-containing peptide sequence
RRRIGVENPKK

SEQ ID NO: 706 - protein, 11 aa, Artificial
  IGFBP-2 heparin binding domain-containing peptide sequence
HRRIGVENPKK

SEQ ID NO: 707 - protein, 11 aa, Artificial
  IGFBP-2 heparin binding domain-containing peptide sequence
KHHVGVENPKK

SEQ ID NO: 708 - protein, 11 aa, Artificial
  IGFBP-2 heparin binding domain-containing peptide sequence
RHHVGVENPKK

SEQ ID NO: 709 - protein, 11 aa, Artificial
  IGFBP-2 heparin binding domain-containing peptide sequence
HHHVGVENPKK

SEQ ID NO: 710 - protein, 11 aa, Artificial
  IGFBP-2 heparin binding domain-containing peptide sequence
KKHVGVENPKK

SEQ ID NO: 711 - protein, 11 aa, Artificial
  IGFBP-2 heparin binding domain-containing peptide sequence
RKHVGVENPKK

SEQ ID NO: 712 - protein, 11 aa, Artificial
  IGFBP-2 heparin binding domain-containing peptide sequence
HKHVGVENPKK

SEQ ID NO: 713 - protein, 11 aa, Artificial
  IGFBP-2 heparin binding domain-containing peptide sequence
KRHVGVENPKK

SEQ ID NO: 714 - protein, 11 aa, Artificial
  IGFBP-2 heparin binding domain-containing peptide sequence
RRHVGVENPKK

SEQ ID NO: 715 - protein, 11 aa, Artificial
  IGFBP-2 heparin binding domain-containing peptide sequence
HRHVGVENPKK

SEQ ID NO: 716 - protein, 11 aa, Artificial
  IGFBP-2 heparin binding domain-containing peptide sequence
KHKVGVENPKK

SEQ ID NO: 717 - protein, 11 aa, Artificial
  IGFBP-2 heparin binding domain-containing peptide sequence
RHKVGVENPKK

SEQ ID NO: 718 - protein, 11 aa, Artificial
  IGFBP-2 heparin binding domain-containing peptide sequence
HHKVGVENPKK

SEQ ID NO: 719 - protein, 11 aa, Artificial
  IGFBP-2 heparin binding domain-containing peptide sequence
KKKVGVENPKK

SEQ ID NO: 720 - protein, 11 aa, Artificial
  IGFBP-2 heparin binding domain-containing peptide sequence
RKKVGVENPKK

SEQ ID NO: 721 - protein, 11 aa, Artificial
  IGFBP-2 heparin binding domain-containing peptide sequence
HKKVGVENPKK

SEQ ID NO: 722 - protein, 11 aa, Artificial
  IGFBP-2 heparin binding domain-containing peptide sequence
KRKVGVENPKK

SEQ ID NO: 723 - protein, 11 aa, Artificial
  IGFBP-2 heparin binding domain-containing peptide sequence
RRKVGVEEPKK

SEQ ID NO: 724 - protein, 11 aa, Artificial
  IGFBP-2 heparin binding domain-containing peptide sequence
HRKVGVENPKK

SEQ ID NO: 725 - protein, 11 aa, Artificial
  IGFBP-2 heparin binding domain-containing peptide sequence
KHRVGVENPKK

SEQ ID NO: 726 - protein, 11 aa, Artificial
  IGFBP-2 heparin binding domain-containing peptide sequence
RHRVGVENPKK

SEQ ID NO: 727 - protein, 11 aa, Artificial
  IGFBP-2 heparin binding domain-containing peptide sequence
HHRVGVENPKK

SEQ ID NO: 728 - protein, 11 aa, Artificial
  IGFBP-2 heparin binding domain-containing peptide sequence
KKRVGVENPKK

SEQ ID NO: 729 - protein, 11 aa, Artificial
  IGFBP-2 heparin binding domain-containing peptide sequence
RKRVGVENPKK

SEQ ID NO: 730 - protein, 11 aa, Artificial
  IGFBP-2 heparin binding domain-containing peptide sequence
HKRVGVENPKK

SEQ ID NO: 731 - protein, 11 aa, Artificial
  IGFBP-2 heparin binding domain-containing peptide sequence
KRRVGVENPKK

SEQ ID NO: 732 - protein, 11 aa, Artificial
  IGFBP-2 heparin binding domain-containing peptide sequence
RRRVGVENPKK

SEQ ID NO: 733 - protein, 11 aa, Artificial
  IGFBP-2 heparin binding domain-containing peptide sequence
HRRVGVENPKK

SEQ ID NO: 734 - protein, 11 aa, Artificial
  IGFBP-2 heparin binding domain-containing peptide sequence
KHHLGLNNPKK

SEQ ID NO: 735 - protein, 11 aa, Artificial
  IGFBP-2 heparin binding domain-containing peptide sequence
RHHLGLNNPKK

SEQ ID NO: 736 - protein, 11 aa, Artificial
  IGFBP-2 heparin binding domain-containing peptide sequence
HHHLGLNNPKK

SEQ ID NO: 737 - protein, 11 aa, Artificial
  IGFBP-2 heparin binding domain-containing peptide sequence
KKHLGLNNPKK

SEQ ID NO: 738 - protein, 11 aa, Artificial
  IGFBP-2 heparin binding domain-containing peptide sequence
RKHLGLNNPKK

SEQ ID NO: 739 - protein, 11 aa, Artificial
  IGFBP-2 heparin binding domain-containing peptide sequence
HKHLGLNNPKK

SEQ ID NO: 740 - protein, 11 aa, Artificial
  IGFBP-2 heparin binding domain-containing peptide sequence
KRHLGLNNPKK

SEQ ID NO: 741 - protein, 11 aa, Artificial
  IGFBP-2 heparin binding domain-containing peptide sequence
RRHLGLNNPKK

SEQ ID NO: 742 - protein, 11 aa, Artificial
  IGFBP-2 heparin binding domain-containing peptide sequence
HRHLGLNNPKK

SEQ ID NO: 743 - protein, 11 aa, Artificial
  IGFBP-2 heparin binding domain-containing peptide sequence
KHKLGLNNPKK

SEQ ID NO: 744 - protein, 11 aa, Artificial
  IGFBP-2 heparin binding domain-containing peptide sequence
RHKLGLNNPKK

SEQ ID NO: 745 - protein, 11 aa, Artificial
  IGFBP-2 heparin binding domain-containing peptide sequence
HHKLGLNNPKK

SEQ ID NO: 746 - protein, 11 aa, Artificial
  IGFBP-2 heparin binding domain-containing peptide sequence
KKKLGLNNPKK

SEQ ID NO: 747 - protein, 11 aa, Artificial
  IGFBP-2 heparin binding domain-containing peptide sequence
RKKLGLNNPKK

SEQ ID NO: 748 - protein, 11 aa, Artificial
  IGFBP-2 heparin binding domain-containing peptide sequence
HKKLGLNNPKK

SEQ ID NO: 749 - protein, 11 aa, Artificial
  IGFBP-2 heparin binding domain-containing peptide sequence
KRKLGLNNPKK

SEQ ID NO: 750 - protein, 11 aa, Artificial
  IGFBP-2 heparin binding domain-containing peptide sequence
RRKLGLNNPKK

SEQ ID NO: 751 - protein, 11 aa, Artificial
  IGFBP-2 heparin binding domain-containing peptide sequence
HRKLGLNNPKK

SEQ ID NO: 752 - protein, 11 aa, Artificial
  IGFBP-2 heparin binding domain-containing peptide sequence
KHRLGLNNPKK

SEQ ID NO: 753 - protein, 11 aa, Artificial
  IGFBP-2 heparin binding domain-containing peptide sequence
RHRLGLNNPKK

SEQ ID NO: 754 - protein, 11 aa, Artificial
  IGFBP-2 heparin binding domain-containing peptide sequence
HHRLGLNNPKK

SEQ ID NO: 755 - protein, 11 aa, Artificial
  IGFBP-2 heparin binding domain-containing peptide sequence
KKRLGLNNPKK

SEQ ID NO: 756 - protein, 11 aa, Artificial
  IGFBP-2 heparin binding domain-containing peptide sequence
RKRLGLNNPKK

SEQ ID NO: 757 - protein, 11 aa, Artificial
  IGFBP-2 heparin binding domain-containing peptide sequence
HKRLGLNNPKK

SEQ ID NO: 758 - protein, 11 aa, Artificial
  IGFBP-2 heparin binding domain-containing peptide sequence
KRRLGLNNPKK

SEQ ID NO: 759 - protein, 11 aa, Artificial
  IGFBP-2 heparin binding domain-containing peptide sequence
RRRLGLNNPKK

SEQ ID NO: 760 - protein, 11 aa, Artificial
  IGFBP-2 heparin binding domain-containing peptide sequence
HRRLGLNNPKK

SEQ ID NO: 761 - protein, 11 aa, Artificial
  IGFBP-2 heparin binding domain-containing peptide sequence
KHHIGLNNPKK

SEQ ID NO: 762 - protein, 11 aa, Artificial
  IGFBP-2 heparin binding domain-containing peptide sequence
RHHIGLNNPKK

SEQ ID NO: 763 - protein, 11 aa, Artificial
  IGFBP-2 heparin binding domain-containing peptide sequence
HHHIGLNNPKK

SEQ ID NO: 764 - protein, 11 aa, Artificial
  IGFBP-2 heparin binding domain-containing peptide sequence
KKHIGLNNPKK

SEQ ID NO: 765 - protein, 11 aa, Artificial
  IGFBP-2 heparin binding domain-containing peptide sequence
RKHIGLNNPKK

SEQ ID NO: 766 - protein, 11 aa, Artificial
  IGFBP-2 heparin binding domain-containing peptide sequence
HKHIGLNNPKK

SEQ ID NO: 767 - protein, 11 aa, Artificial
  IGFBP-2 heparin binding domain-containing peptide sequence
KRHIGLNNPKK

SEQ ID NO: 768 - protein, 11 aa, Artificial
  IGFBP-2 heparin binding domain-containing peptide sequence
RRHIGLNNPKK

SEQ ID NO: 769 - protein, 11 aa, Artificial
  IGFBP-2 heparin binding domain-containing peptide sequence
HRHIGLNNPKK

SEQ ID NO: 770 - protein, 11 aa, Artificial
  IGFBP-2 heparin binding domain-containing peptide sequence
KHKIGLNNPKK

SEQ ID NO: 771 - protein, 11 aa, Artificial
  IGFBP-2 heparin binding domain-containing peptide sequence
RHKIGLNNPKK

SEQ ID NO: 772 - protein, 11 aa, Artificial
  IGFBP-2 heparin binding domain-containing peptide sequence
HHKIGLNNPKK

SEQ ID NO: 773 - protein, 11 aa, Artificial
  IGFBP-2 heparin binding domain-containing peptide sequence
KKKIGLNNPKK

SEQ ID NO: 774 - protein, 11 aa, Artificial
  IGFBP-2 heparin binding domain-containing peptide sequence
RKKIGLNNPKK

SEQ ID NO: 775 - protein, 11 aa, Artificial
  IGFBP-2 heparin binding domain-containing peptide sequence
HKKIGLNNPKK

SEQ ID NO: 776 - protein, 11 aa, Artificial
  IGFBP-2 heparin binding domain-containing peptide sequence
KRKIGLNNPKK

SEQ ID NO: 777 - protein, 11 aa, Artificial
  IGFBP-2 heparin binding domain-containing peptide sequence
RRKIGLNNPKK

SEQ ID NO: 778 - protein, 11 aa, Artificial
  IGFBP-2 heparin binding domain-containing peptide sequence
HRKIGLNNPKK

SEQ ID NO: 779 - protein, 11 aa, Artificial
  IGFBP-2 heparin binding domain-containing peptide sequence
KHRIGLNNPKK

SEQ ID NO: 780 - protein, 11 aa, Artificial
  IGFBP-2 heparin binding domain-containing peptide sequence
RHRIGLNNPKK

SEQ ID NO: 781 - protein, 11 aa, Artificial
  IGFBP-2 heparin binding domain-containing peptide sequence
HHRIGLNNPKK

SEQ ID NO: 782 - protein, 11 aa, Artificial
  IGFBP-2 heparin binding domain-containing peptide sequence
KKRIGLNNPKK

SEQ ID NO: 783 - protein, 11 aa, Artificial
  IGFBP-2 heparin binding domain-containing peptide sequence
RKRIGLNNPKK

SEQ ID NO: 784 - protein, 11 aa, Artificial
  IGFBP-2 heparin binding domain-containing peptide sequence
HKRIGLNNPKK

SEQ ID NO: 785 - protein, 11 aa, Artificial
  IGFBP-2 heparin binding domain-containing peptide sequence
KRRIGLNNPKK

SEQ ID NO: 786 - protein, 11 aa, Artificial
  IGFBP-2 heparin binding domain-containing peptide sequence
RRRIGLNNPKK

SEQ ID NO: 787 - protein, 11 aa, Artificial
  IGFBP-2 heparin binding domain-containing peptide sequence
HRRIGLNNPKK

SEQ ID NO: 788 - protein, 11 aa, Artificial
  IGFBP-2 heparin binding domain-containing peptide sequence
KHHVGLNNPKK

SEQ ID NO: 789 - protein, 11 aa, Artificial
  IGFBP-2 heparin binding domain-containing peptide sequence
RHHVGLNNPKK

SEQ ID NO: 790 - protein, 11 aa, Artificial
  IGFBP-2 heparin binding domain-containing peptide sequence
HHHVGLNNPKK

SEQ ID NO: 791 - protein, 11 aa, Artificial
  IGFBP-2 heparin binding domain-containing peptide sequence
KKHVGLNNPKK

SEQ ID NO: 792 - protein, 11 aa, Artificial
  IGFBP-2 heparin binding domain-containing peptide sequence
RKHVGLNNPKK

SEQ ID NO: 793 - protein, 11 aa, Artificial
  IGFBP-2 heparin binding domain-containing peptide sequence
HKHVGLNNPKK

SEQ ID NO: 794 - protein, 11 aa, Artificial
  IGFBP-2 heparin binding domain-containing peptide sequence
KRHVGLNNPKK

SEQ ID NO: 795 - protein, 11 aa, Artificial
  IGFBP-2 heparin binding domain-containing peptide sequence
RRHVGLNNPKK

SEQ ID NO: 796 - protein, 11 aa, Artificial
  IGFBP-2 heparin binding domain-containing peptide sequence
HRHVGLNNPKK

SEQ ID NO: 797 - protein, 11 aa, Artificial
  IGFBP-2 heparin binding domain-containing peptide sequence
KHKVGLNNPKK

SEQ ID NO: 798 - protein, 11 aa, Artificial
  IGFBP-2 heparin binding domain-containing peptide sequence
RHKVGLNNPKK

SEQ ID NO: 799 - protein, 11 aa, Artificial
  IGFBP-2 heparin binding domain-containing peptide sequence
HHKVGLNNPKK

SEQ ID NO: 800 - protein, 11 aa, Artificial
  IGFBP-2 heparin binding domain-containing peptide sequence
KKKVGLNNPKK

SEQ ID NO: 801 - protein, 11 aa, Artificial
  IGFBP-2 heparin binding domain-containing peptide sequence
RKKVGLNNPKK

SEQ ID NO: 802 - protein, 11 aa, Artificial
  IGFBP-2 heparin binding domain-containing peptide sequence
HKKVGLNNPKK

SEQ ID NO: 803 - protein, 11 aa, Artificial
  IGFBP-2 heparin binding domain-containing peptide sequence
KRKVGLNNPKK

SEQ ID NO: 804 - protein, 11 aa, Artificial
  IGFBP-2 heparin binding domain-containing peptide sequence
RRKVGLNNPKK

SEQ ID NO: 805 - protein, 11 aa, Artificial
  IGFBP-2 heparin binding domain-containing peptide sequence
HRKVGLNNPKK

SEQ ID NO: 806 - protein, 11 aa, Artificial
  IGFBP-2 heparin binding domain-containing peptide sequence
KHRVGLNNPKK

SEQ ID NO: 807 - protein, 11 aa, Artificial
  IGFBP-2 heparin binding domain-containing peptide sequence
RHRVGLNNPKK

SEQ ID NO: 808 - protein, 11 aa, Artificial
  IGFBP-2 heparin binding domain-containing peptide sequence
HHRVGLNNPKK

SEQ ID NO: 809 - protein, 11 aa, Artificial
  IGFBP-2 heparin binding domain-containing peptide sequence
KKRVGLNNPKK

SEQ ID NO: 810 - protein, 11 aa, Artificial
  IGFBP-2 heparin binding domain-containing peptide sequence
RKRVGLNNPKK

SEQ ID NO: 811 - protein, 11 aa, Artificial
  IGFBP-2 heparin binding domain-containing peptide sequence
HKRVGLNNPKK

SEQ ID NO: 812 - protein, 11 aa, Artificial
  IGFBP-2 heparin binding domain-containing peptide sequence
KRRVGLNNPKK

SEQ ID NO: 813 - protein, 11 aa, Artificial
  IGFBP-2 heparin binding domain-containing peptide sequence
RRRVGLNNPKK

SEQ ID NO: 814 - protein, 11 aa, Artificial
  IGFBP-2 heparin binding domain-containing peptide sequence
HRRVGLNNPKK

SEQ ID NO: 815 - protein, 11 aa, Artificial
  IGFBP-2 heparin binding domain-containing peptide sequence
KHHLGINNPKK

SEQ ID NO: 816 - protein, 11 aa, Artificial
  IGFBP-2 heparin binding domain-containing peptide sequence
RHHLGINNPKK

SEQ ID NO: 817 - protein, 11 aa, Artificial
  IGFBP-2 heparin binding domain-containing peptide sequence
HHHLGINNPKK

SEQ ID NO: 818 - protein, 11 aa, Artificial
  IGFBP-2 heparin binding domain-containing peptide sequence
KKHLGINNPKK

SEQ ID NO: 819 - protein, 11 aa, Artificial
  IGFBP-2 heparin binding domain-containing peptide sequence
RKHLGINNPKK

SEQ ID NO: 820 - protein, 11 aa, Artificial
  IGFBP-2 heparin binding domain-containing peptide sequence
HKHLGINNPKK

SEQ ID NO: 821 - protein, 11 aa, Artificial
  IGFBP-2 heparin binding domain-containing peptide sequence
KRHLGINNPKK

SEQ ID NO: 822 - protein, 11 aa, Artificial
  IGFBP-2 heparin binding domain-containing peptide sequence
RRHLGINNPKK

SEQ ID NO: 823 - protein, 11 aa, Artificial
  IGFBP-2 heparin binding domain-containing peptide sequence
HRHLGINNPKK

SEQ ID NO: 824 - protein, 11 aa, Artificial
  IGFBP-2 heparin binding domain-containing peptide sequence
KHKLGINNPKK

SEQ ID NO: 825 - protein, 11 aa, Artificial
  IGFBP-2 heparin binding domain-containing peptide sequence
RHKLGINNPKK

SEQ ID NO: 826 - protein, 11 aa, Artificial
  IGFBP-2 heparin binding domain-containing peptide sequence
HHKLGINNPKK

SEQ ID NO: 827 - protein, 11 aa, Artificial
  IGFBP-2 heparin binding domain-containing peptide sequence
KKKLGINNPKK

SEQ ID NO: 828 - protein, 11 aa, Artificial
  IGFBP-2 heparin binding domain-containing peptide sequence
RKKLGINNPKK

SEQ ID NO: 829 - protein, 11 aa, Artificial
  IGFBP-2 heparin binding domain-containing peptide sequence
HKKLGINNPKK

SEQ ID NO: 830 - protein, 11 aa, Artificial
  IGFBP-2 heparin binding domain-containing peptide sequence
KRKLGINNPKK

SEQ ID NO: 831 - protein, 11 aa, Artificial
  IGFBP-2 heparin binding domain-containing peptide sequence
RRKLGINNPKK

SEQ ID NO: 832 - protein, 11 aa, Artificial
  IGFBP-2 heparin binding domain-containing peptide sequence
HRKLGINNPKK

SEQ ID NO: 833 - protein, 11 aa, Artificial
  IGFBP-2 heparin binding domain-containing peptide sequence
KHRLGINNPKK

SEQ ID NO: 834 - protein, 11 aa, Artificial
  IGFBP-2 heparin binding domain-containing peptide sequence
RHRLGINNPKK

SEQ ID NO: 835 - protein, 11 aa, Artificial
  IGFBP-2 heparin binding domain-containing peptide sequence
HHRLGINNPKK

SEQ ID NO: 836 - protein, 11 aa, Artificial
  IGFBP-2 heparin binding domain-containing peptide sequence
KKRLGINNPKK

SEQ ID NO: 837 - protein, 11 aa, Artificial
  IGFBP-2 heparin binding domain-containing peptide sequence
RKRLGINNPKK

SEQ ID NO: 838 - protein, 11 aa, Artificial
  IGFBP-2 heparin binding domain-containing peptide sequence
HKRLGINNPKK

SEQ ID NO: 839 - protein, 11 aa, Artificial
  IGFBP-2 heparin binding domain-containing peptide sequence
KRRLGINNPKK

SEQ ID NO: 840 - protein, 11 aa, Artificial
  IGFBP-2 heparin binding domain-containing peptide sequence
RRRLGINNPKK

SEQ ID NO: 841 - protein, 11 aa, Artificial
  IGFBP-2 heparin binding domain-containing peptide sequence
HRRLGINNPKK

SEQ ID NO: 842 - protein, 11 aa, Artificial
  IGFBP-2 heparin binding domain-containing peptide sequence
KHHIGIENPKK

SEQ ID NO: 843 - protein, 11 aa, Artificial
  IGFBP-2 heparin binding domain-containing peptide sequence
RHHIGINNPKK

SEQ ID NO: 844 - protein, 11 aa, Artificial
  IGFBP-2 heparin binding domain-containing peptide sequence
HHHIGINNPKK

SEQ ID NO: 845 - protein, 11 aa, Artificial
  IGFBP-2 heparin binding domain-containing peptide sequence
KKHIGINNPKK

SEQ ID NO: 846 - protein, 11 aa, Artificial
  IGFBP-2 heparin binding domain-containing peptide sequence
RKHIGINNPKK

SEQ ID NO: 847 - protein, 11 aa, Artificial
  IGFBP-2 heparin binding domain-containing peptide sequence
HKHIGINNPKK

SEQ ID NO: 848 - protein, 11 aa, Artificial
  IGFBP-2 heparin binding domain-containing peptide sequence
KRHIGINNPKK

SEQ ID NO: 849 - protein, 11 aa, Artificial
  IGFBP-2 heparin binding domain-containing peptide sequence
RRHIGINNPKK

SEQ ID NO: 850 - protein, 11 aa, Artificial
  IGFBP-2 heparin binding domain-containing peptide sequence
HRHIGINNPKK

SEQ ID NO: 851 - protein, 11 aa, Artificial
  IGFBP-2 heparin binding domain-containing peptide sequence
KHKIGINNPKK

SEQ ID NO: 852 - protein, 11 aa, Artificial
  IGFBP-2 heparin binding domain-containing peptide sequence
RHKIGINNPKK

SEQ ID NO: 853 - protein, 11 aa, Artificial
  IGFBP-2 heparin binding domain-containing peptide sequence
HHKIGINNPKK

SEQ ID NO: 854 - protein, 11 aa, Artificial
  IGFBP-2 heparin binding domain-containing peptide sequence
KKKIGINNPKK

SEQ ID NO: 855 - protein, 11 aa, Artificial
  IGFBP-2 heparin binding domain-containing peptide sequence
RKKIGINNPKK

SEQ ID NO: 856 - protein, 11 aa, Artificial
  IGFBP-2 heparin binding domain-containing peptide sequence
HKKIGINNPKK

SEQ ID NO: 857 - protein, 11 aa, Artificial
  IGFBP-2 heparin binding domain-containing peptide sequence
KRKIGINNPKK

SEQ ID NO: 858 - protein, 11 aa, Artificial
  IGFBP-2 heparin binding domain-containing peptide sequence
RRKIGINNPKK

SEQ ID NO: 859 - protein, 11 aa, Artificial
  IGFBP-2 heparin binding domain-containing peptide sequence
HRKIGINNPKK

SEQ ID NO: 860 - protein, 11 aa, Artificial
  IGFBP-2 heparin binding domain-containing peptide sequence
KHRIGINNPKK

SEQ ID NO: 861 - protein, 11 aa, Artificial
  IGFBP-2 heparin binding domain-containing peptide sequence
RHRIGINNPKK

SEQ ID NO: 862 - protein, 11 aa, Artificial
  IGFBP-2 heparin binding domain-containing peptide sequence
HHRIGINNPKK

SEQ ID NO: 863 - protein, 11 aa, Artificial
  IGFBP-2 heparin binding domain-containing peptide sequence
KKRIGINNPKK

SEQ ID NO: 864 - protein, 11 aa, Artificial
  IGFBP-2 heparin binding domain-containing peptide sequence
RKRIGINNPKK

SEQ ID NO: 865 - protein, 11 aa, Artificial
  IGFBP-2 heparin binding domain-containing peptide sequence
HKRIGINNPKK

SEQ ID NO: 866 - protein, 11 aa, Artificial
  IGFBP-2 heparin binding domain-containing peptide sequence
KRRIGINNPKK

SEQ ID NO: 867 - protein, 11 aa, Artificial
  IGFBP-2 heparin binding domain-containing peptide sequence
RRRIGINNPKK

SEQ ID NO: 868 - protein, 11 aa, Artificial
  IGFBP-2 heparin binding domain-containing peptide sequence
HRRIGINNPKK

SEQ ID NO: 869 - protein, 11 aa, Artificial
  IGFBP-2 heparin binding domain-containing peptide sequence
KHHVGINNPKK

SEQ ID NO: 870 - protein, 11 aa, Artificial
  IGFBP-2 heparin binding domain-containing peptide sequence
RHHVGINNPKK

SEQ ID NO: 871 - protein, 11 aa, Artificial
  IGFBP-2 heparin binding domain-containing peptide sequence
HHHVGINNPKK

SEQ ID NO: 872 - protein, 11 aa, Artificial
  IGFBP-2 heparin binding domain-containing peptide sequence
KKHVGINNPKK

SEQ ID NO: 873 - protein, 11 aa, Artificial
  IGFBP-2 heparin binding domain-containing peptide sequence
RKHVGINNPKK

SEQ ID NO: 874 - protein, 11 aa, Artificial
  IGFBP-2 heparin binding domain-containing peptide sequence
HKHVGINNPKK

SEQ ID NO: 875 - protein, 11 aa, Artificial
  IGFBP-2 heparin binding domain-containing peptide sequence
KRHVGINNPKK

SEQ ID NO: 876 - protein, 11 aa, Artificial
  IGFBP-2 heparin binding domain-containing peptide sequence
RRHVGINNPKK

SEQ ID NO: 877 - protein, 11 aa, Artificial
  IGFBP-2 heparin binding domain-containing peptide sequence
HRHVGINNPKK

SEQ ID NO: 878 - protein, 11 aa, Artificial
  IGFBP-2 heparin binding domain-containing peptide sequence
KHKVGINNPKK

SEQ ID NO: 879 - protein, 11 aa, Artificial
  IGFBP-2 heparin binding domain-containing peptide sequence
RHKVGINNPKK

SEQ ID NO: 880 - protein, 11 aa, Artificial
  IGFBP-2 heparin binding domain-containing peptide sequence
HHKVGINNPKK

SEQ ID NO: 881 - protein, 11 aa, Artificial
  IGFBP-2 heparin binding domain-containing peptide sequence
KKKVGINNPKK

SEQ ID NO: 882 - protein, 11 aa, Artificial
  IGFBP-2 heparin binding domain-containing peptide sequence
RKKVGINNPKK

SEQ ID NO: 883 - protein, 11 aa, Artificial
  IGFBP-2 heparin binding domain-containing peptide sequence
HKKVGINNPKK

SEQ ID NO: 884 - protein, 11 aa, Artificial
  IGFBP-2 heparin binding domain-containing peptide sequence
KRKVGINNPKK

SEQ ID NO: 885 - protein, 11 aa, Artificial
  IGFBP-2 heparin binding domain-containing peptide sequence
RRKVGINNPKK

SEQ ID NO: 886 - protein, 11 aa, Artificial
  IGFBP-2 heparin binding domain-containing peptide sequence
HRKVGINNPKK

SEQ ID NO: 887 - protein, 11 aa, Artificial
  IGFBP-2 heparin binding domain-containing peptide sequence
KHRVGINNPKK

SEQ ID NO: 888 - protein, 11 aa, Artificial
  IGFBP-2 heparin binding domain-containing peptide sequence
RHRVGINNPKK

SEQ ID NO: 889 - protein, 11 aa, Artificial
  IGFBP-2 heparin binding domain-containing peptide sequence
HHRVGINNPKK

SEQ ID NO: 890 - protein, 11 aa, Artificial
  IGFBP-2 heparin binding domain-containing peptide sequence
KKRVGINNPKK

SEQ ID NO: 891 - protein, 11 aa, Artificial
  IGFBP-2 heparin binding domain-containing peptide sequence
RKRVGINNPKK

SEQ ID NO: 892 - protein, 11 aa, Artificial
  IGFBP-2 heparin binding domain-containing peptide sequence
HKRVGINNPKK

SEQ ID NO: 893 - protein, 11 aa, Artificial
  IGFBP-2 heparin binding domain-containing peptide sequence
KRRVGINNPKK

SEQ ID NO: 894 - protein, 11 aa, Artificial
  IGFBP-2 heparin binding domain-containing peptide sequence
RRRVGINNPKK

SEQ ID NO: 895 - protein, 11 aa, Artificial
  IGFBP-2 heparin binding domain-containing peptide sequence
HRRVGINNPKK

SEQ ID NO: 896 - protein, 11 aa, Artificial
  IGFBP-2 heparin binding domain-containing peptide sequence
KHHLGVNNPKK

SEQ ID NO: 897 - protein, 11 aa, Artificial
  IGFBP-2 heparin binding domain-containing peptide sequence
RHHLGVNNPKK

SEQ ID NO: 898 - protein, 11 aa, Artificial
  IGFBP-2 heparin binding domain-containing peptide sequence
HHHLGVNNPKK

SEQ ID NO: 899 - protein, 11 aa, Artificial
  IGFBP-2 heparin binding domain-containing peptide sequence
KKHLGVNNPKK

SEQ ID NO: 900 - protein, 11 aa, Artificial
  IGFBP-2 heparin binding domain-containing peptide sequence
RKHLGVNNPKK

SEQ ID NO: 901 - protein, 11 aa, Artificial
  IGFBP-2 heparin binding domain-containing peptide sequence
HKHLGVNNPKK

SEQ ID NO: 902 - protein, 11 aa, Artificial
  IGFBP-2 heparin binding domain-containing peptide sequence
KRHLGVNNPKK

SEQ ID NO: 903 - protein, 11 aa, Artificial
  IGFBP-2 heparin binding domain-containing peptide sequence
RRHLGVNNPKK

SEQ ID NO: 904 - protein, 11 aa, Artificial
  IGFBP-2 heparin binding domain-containing peptide sequence
HRHLGVNNPKK

SEQ ID NO: 905 - protein, 11 aa, Artificial
  IGFBP-2 heparin binding domain-containing peptide sequence
KHKLGVNNPKK

SEQ ID NO: 906 - protein, 11 aa, Artificial
  IGFBP-2 heparin binding domain-containing peptide sequence
RHKLGVNNPKK

SEQ ID NO: 907 - protein, 11 aa, Artificial
  IGFBP-2 heparin binding domain-containing peptide sequence
HHKLGVNNPKK

SEQ ID NO: 908 - protein, 11 aa, Artificial
  IGFBP-2 heparin binding domain-containing peptide sequence
KKKLGVNNPKK

SEQ ID NO: 909 - protein, 11 aa, Artificial
  IGFBP-2 heparin binding domain-containing peptide sequence
RKKLGVNNPKK

SEQ ID NO: 910 - protein, 11 aa, Artificial
  IGFBP-2 heparin binding domain-containing peptide sequence
HKKLGVNNPKK

SEQ ID NO: 911 - protein, 11 aa, Artificial
  IGFBP-2 heparin binding domain-containing peptide sequence
KRKLGVNNPKK

SEQ ID NO: 912 - protein, 11 aa, Artificial
  IGFBP-2 heparin binding domain-containing peptide sequence
RRKLGVNNPKK

SEQ ID NO: 913 - protein, 11 aa, Artificial
  IGFBP-2 heparin binding domain-containing peptide sequence
HRKLGVNNPKK

SEQ ID NO: 914 - protein, 11 aa, Artificial
  IGFBP-2 heparin binding domain-containing peptide sequence
KHRLGVNNPKK

SEQ ID NO: 915 - protein, 11 aa, Artificial
  IGFBP-2 heparin binding domain-containing peptide sequence
RHRLGVNNPKK

SEQ ID NO: 916 - protein, 11 aa, Artificial
  IGFBP-2 heparin binding domain-containing peptide sequence
HHRLGVNNPKK

SEQ ID NO: 917 - protein, 11 aa, Artificial
  IGFBP-2 heparin binding domain-containing peptide sequence
KKRLGVNNPKK

SEQ ID NO: 918 - protein, 11 aa, Artificial
  IGFBP-2 heparin binding domain-containing peptide sequence
RKRLGVNNPKK

SEQ ID NO: 919 - protein, 11 aa, Artificial
  IGFBP-2 heparin binding domain-containing peptide sequence
HKRLGVNNPKK

SEQ ID NO: 920 - protein, 11 aa, Artificial
  IGFBP-2 heparin binding domain-containing peptide sequence
KRRLGVNNPKK

SEQ ID NO: 921 - protein, 11 aa, Artificial
  IGFBP-2 heparin binding domain-containing peptide sequence
RRRLGVNNPKK

SEQ ID NO: 922 - protein, 11 aa, Artificial
  IGFBP-2 heparin binding domain-containing peptide sequence
HRRLGVNNPKK

SEQ ID NO: 923 - protein, 11 aa, Artificial
  IGFBP-2 heparin binding domain-containing peptide sequence
KHHIGVNNPKK

SEQ ID NO: 924 - protein, 11 aa, Artificial
  IGFBP-2 heparin binding domain-containing peptide sequence
RHHIGVNNPKK

SEQ ID NO: 925 - protein, 11 aa, Artificial
  IGFBP-2 heparin binding domain-containing peptide sequence
HHHIGVNNPKK

SEQ ID NO: 926 - protein, 11 aa, Artificial
  IGFBP-2 heparin binding domain-containing peptide sequence
KKHIGVNNPKK

SEQ ID NO: 927 - protein, 11 aa, Artificial
  IGFBP-2 heparin binding domain-containing peptide sequence
RKHIGVNNPKK

SEQ ID NO: 928 - protein, 11 aa, Artificial
  IGFBP-2 heparin binding domain-containing peptide sequence
HKHIGVNNPKK

SEQ ID NO: 929 - protein, 11 aa, Artificial
  IGFBP-2 heparin binding domain-containing peptide sequence
KRHIGVNNPKK

SEQ ID NO: 930 - protein, 11 aa, Artificial
  IGFBP-2 heparin binding domain-containing peptide sequence
RRHIGVNNPKK

SEQ ID NO: 931 - protein, 11 aa, Artificial
  IGFBP-2 heparin binding domain-containing peptide sequence
HRHIGVNNPKK

SEQ ID NO: 932 - protein, 11 aa, Artificial
  IGFBP-2 heparin binding domain-containing peptide sequence
KHKIGVNNPKK

SEQ ID NO: 933 - protein, 11 aa, Artificial
  IGFBP-2 heparin binding domain-containing peptide sequence
RHKIGVNNPKK

SEQ ID NO: 934 - protein, 11 aa, Artificial
  IGFBP-2 heparin binding domain-containing peptide sequence
HHKIGVNNPKK

SEQ ID NO: 935 - protein, 11 aa, Artificial
  IGFBP-2 heparin binding domain-containing peptide sequence
KKKIGVNNPKK

SEQ ID NO: 936 - protein, 11 aa, Artificial
  IGFBP-2 heparin binding domain-containing peptide sequence
RKKIGVNNPKK

SEQ ID NO: 937 - protein, 11 aa, Artificial
  IGFBP-2 heparin binding domain-containing peptide sequence
HKKIGVNNPKK

SEQ ID NO: 938 - protein, 11 aa, Artificial
  IGFBP-2 heparin binding domain-containing peptide sequence
KRKIGVNNPKK

SEQ ID NO: 939 - protein, 11 aa, Artificial
  IGFBP-2 heparin binding domain-containing peptide sequence
RRKIGVNNPKK

SEQ ID NO: 940 - protein, 11 aa, Artificial
  IGFBP-2 heparin binding domain-containing peptide sequence
HRKIGVNNPKK

SEQ ID NO: 941 - protein, 11 aa, Artificial
  IGFBP-2 heparin binding domain-containing peptide sequence
KHRIGVNNPKK

SEQ ID NO: 942 - protein, 11 aa, Artificial
  IGFBP-2 heparin binding domain-containing peptide sequence
RHRIGVNNPKK

SEQ ID NO: 943 - protein, 11 aa, Artificial
  IGFBP-2 heparin binding domain-containing peptide sequence
HHRIGVNNPKK

SEQ ID NO: 944 - protein, 11 aa, Artificial
  IGFBP-2 heparin binding domain-containing peptide sequence
KKRIGVNNPKK

SEQ ID NO: 945 - protein, 11 aa, Artificial
  IGFBP-2 heparin binding domain-containing peptide sequence
RKRIGVNNPKK

SEQ ID NO: 946 - protein, 11 aa, Artificial
  IGFBP-2 heparin binding domain-containing peptide sequence
HKRIGVNNPKK

SEQ ID NO: 947 - protein, 11 aa, Artificial
  IGFBP-2 heparin binding domain-containing peptide sequence
KRRIGVNNPKK

SEQ ID NO: 948 - protein, 11 aa, Artificial
  IGFBP-2 heparin binding domain-containing peptide sequence
RRRIGVNNPKK

SEQ ID NO: 949 - protein, 11 aa, Artificial
  IGFBP-2 heparin binding domain-containing peptide sequence
HRRIGVNNPKK

SEQ ID NO: 950 - protein, 11 aa, Artificial
  IGFBP-2 heparin binding domain-containing peptide sequence
KHHVGVNNPKK

SEQ ID NO: 951 - protein, 11 aa, Artificial
  IGFBP-2 heparin binding domain-containing peptide sequence
RHHVGVNNPKK

SEQ ID NO: 952 - protein, 11 aa, Artificial
  IGFBP-2 heparin binding domain-containing peptide sequence
HHHVGVNNPKK

SEQ ID NO: 953 - protein, 11 aa, Artificial
  IGFBP-2 heparin binding domain-containing peptide sequence
KKHVGVNNPKK

SEQ ID NO: 954 - protein, 11 aa, Artificial
  IGFBP-2 heparin binding domain-containing peptide sequence
RKHVGVNNPKK

SEQ ID NO: 955 - protein, 11 aa, Artificial
  IGFBP-2 heparin binding domain-containing peptide sequence
HKHVGVNNPKK

SEQ ID NO: 956 - protein, 11 aa, Artificial
  IGFBP-2 heparin binding domain-containing peptide sequence
KRHVGVNNPKK

SEQ ID NO: 957 - protein, 11 aa, Artificial
  IGFBP-2 heparin binding domain-containing peptide sequence
RRHVGVNNPKK

SEQ ID NO: 958 - protein, 11 aa, Artificial
  IGFBP-2 heparin binding domain-containing peptide sequence
HRHVGVNNPKK

SEQ ID NO: 959 - protein, 11 aa, Artificial
  IGFBP-2 heparin binding domain-containing peptide sequence
KHKVGVNNPKK

SEQ ID NO: 960 - protein, 11 aa, Artificial
  IGFBP-2 heparin binding domain-containing peptide sequence
RHKVGVNNPKK

SEQ ID NO: 961 - protein, 11 aa, Artificial
  IGFBP-2 heparin binding domain-containing peptide sequence
HHKVGVNNPKK

SEQ ID NO: 962 - protein, 11 aa, Artificial
  IGFBP-2 heparin binding domain-containing peptide sequence
KKKVGVNNPKK

SEQ ID NO: 963 - protein, 11 aa, Artificial
  IGFBP-2 heparin binding domain-containing peptide sequence
RKKVGVNNPKK

SEQ ID NO: 964 - protein, 11 aa, Artificial
  IGFBP-2 heparin binding domain-containing peptide sequence
HKKVGVNNPKK

SEQ ID NO: 965 - protein, 11 aa, Artificial
  IGFBP-2 heparin binding domain-containing peptide sequence
KRKVGVNNPKK

SEQ ID NO: 966 - protein, 11 aa, Artificial
  IGFBP-2 heparin binding domain-containing peptide sequence
RRKVGVNNPKK

SEQ ID NO: 967 - protein, 11 aa, Artificial
  IGFBP-2 heparin binding domain-containing peptide sequence
HRKVGVNNPKK

SEQ ID NO: 968 - protein, 11 aa, Artificial
  IGFBP-2 heparin binding domain-containing peptide sequence
KHRVGVNNPKK

SEQ ID NO: 969 - protein, 11 aa, Artificial
  IGFBP-2 heparin binding domain-containing peptide sequence
RHRVGVNNPKK

SEQ ID NO: 970 - protein, 11 aa, Artificial
  IGFBP-2 heparin binding domain-containing peptide sequence
HHRVGVNNPKK

SEQ ID NO: 971 - protein, 11 aa, Artificial
  IGFBP-2 heparin binding domain-containing peptide sequence
KKRVGVNNPKK

SEQ ID NO: 972 - protein, 11 aa, Artificial
  IGFBP-2 heparin binding domain-containing peptide sequence
RKRVGVNNPKK

SEQ ID NO: 973 - protein, 11 aa, Artificial
  IGFBP-2 heparin binding domain-containing peptide sequence
HKRVGVNNPKK

SEQ ID NO: 974 - protein, 11 aa, Artificial
  IGFBP-2 heparin binding domain-containing peptide sequence
KRRVGVNNPKK

SEQ ID NO: 975 - protein, 11 aa, Artificial
  IGFBP-2 heparin binding domain-containing peptide sequence
RRRVGVNNPKK

SEQ ID NO: 976 - protein, 11 aa, Artificial
  IGFBP-2 heparin binding domain-containing peptide sequence
HRRVGVNNPKK

SEQ ID NO: 977 - protein, 11 aa, Artificial
  IGFBP-2 heparin binding domain-containing peptide sequence
KHHLGLEEPKR

SEQ ID NO: 978 - protein, 11 aa, Artificial
  IGFBP-2 heparin binding domain-containing peptide sequence
RHHLGLEEPKR

SEQ ID NO: 979 - protein, 11 aa, Artificial
  IGFBP-2 heparin binding domain-containing peptide sequence
HHHLGLEEPKR

SEQ ID NO: 980 - protein, 11 aa, Artificial
  IGFBP-2 heparin binding domain-containing peptide sequence
KKHLGLEEPKR

SEQ ID NO: 981 - protein, 11 aa, Artificial
  IGFBP-2 heparin binding domain-containing peptide sequence
RKHLGLEEPKR

SEQ ID NO: 982 - protein, 11 aa, Artificial
  IGFBP-2 heparin binding domain-containing peptide sequence
HKHLGLEEPKR

SEQ ID NO: 983 - protein, 11 aa, Artificial
  IGFBP-2 heparin binding domain-containing peptide sequence
KRHLGLEEPKR

SEQ ID NO: 984 - protein, 11 aa, Artificial
  IGFBP-2 heparin binding domain-containing peptide sequence
RRHLGLEEPKR

SEQ ID NO: 985 - protein, 11 aa, Artificial
  IGFBP-2 heparin binding domain-containing peptide sequence
HRHLGLEEPKR

SEQ ID NO: 986 - protein, 11 aa, Artificial
  IGFBP-2 heparin binding domain-containing peptide sequence
KHKLGLEEPKR

SEQ ID NO: 987 - protein, 11 aa, Artificial
  IGFBP-2 heparin binding domain-containing peptide sequence
RHKLGLEEPKR

SEQ ID NO: 988 - protein, 11 aa, Artificial
  IGFBP-2 heparin binding domain-containing peptide sequence
HHKLGLEEPKR

SEQ ID NO: 989 - protein, 11 aa, Artificial
  IGFBP-2 heparin binding domain-containing peptide sequence
KKKLGLEEPKR

SEQ ID NO: 990 - protein, 11 aa, Artificial
  IGFBP-2 heparin binding domain-containing peptide sequence
RKKLGLEEPKR

SEQ ID NO: 991 - protein, 11 aa, Artificial
  IGFBP-2 heparin binding domain-containing peptide sequence
HKKLGLEEPKR

SEQ ID NO: 992 - protein, 11 aa, Artificial
  IGFBP-2 heparin binding domain-containing peptide sequence
KRKLGLEEPKR

SEQ ID NO: 993 - protein, 11 aa, Artificial
  IGFBP-2 heparin binding domain-containing peptide sequence
RRKLGLEEPKR

SEQ ID NO: 994 - protein, 11 aa, Artificial
  IGFBP-2 heparin binding domain-containing peptide sequence
HRKLGLEEPKR

SEQ ID NO: 995 - protein, 11 aa, Artificial
  IGFBP-2 heparin binding domain-containing peptide sequence
KHRLGLEEPKR

SEQ ID NO: 996 - protein, 11 aa, Artificial
  IGFBP-2 heparin binding domain-containing peptide sequence
RHRLGLEEPKR

SEQ ID NO: 997 - protein, 11 aa, Artificial
  IGFBP-2 heparin binding domain-containing peptide sequence
HHRLGLEEPKR

SEQ ID NO: 998 - protein, 11 aa, Artificial
  IGFBP-2 heparin binding domain-containing peptide sequence
KKRLGLEEPKR

SEQ ID NO: 999 - protein, 11 aa, Artificial
  IGFBP-2 heparin binding domain-containing peptide sequence
RKRLGLEEPKR

SEQ ID NO: 1000 - protein, 11 aa, Artificial
  IGFBP-2 heparin binding domain-containing peptide sequence
HKRLGLEEPKR

SEQ ID NO: 1001 - protein, 11 aa, Artificial
  IGFBP-2 heparin binding domain-containing peptide sequence
KRRLGLEEPKR

SEQ ID NO: 1002 - protein, 11 aa, Artificial
  IGFBP-2 heparin binding domain-containing peptide sequence
RRRLGLEEPKR

SEQ ID NO: 1003 - protein, 11 aa, Artificial
  IGFBP-2 heparin binding domain-containing peptide sequence
HRRLGLEEPKR

SEQ ID NO: 1004 - protein, 11 aa, Artificial
  IGFBP-2 heparin binding domain-containing peptide sequence
KHHIGLEEPKR

SEQ ID NO: 1005 - protein, 11 aa, Artificial
  IGFBP-2 heparin binding domain-containing peptide sequence
RHHIGLEEPKR

SEQ ID NO: 1006 - protein, 11 aa, Artificial
  IGFBP-2 heparin binding domain-containing peptide sequence
HHHIGLEEPKR

SEQ ID NO: 1007 - protein, 11 aa, Artificial
  IGFBP-2 heparin binding domain-containing peptide sequence
KKHIGLEEPKR

SEQ ID NO: 1008 - protein, 11 aa, Artificial
  IGFBP-2 heparin binding domain-containing peptide sequence
RKHIGLEEPKR

SEQ ID NO: 1009 - protein, 11 aa, Artificial
  IGFBP-2 heparin binding domain-containing peptide sequence
HKHIGLEEPKR

SEQ ID NO: 1010 - protein, 11 aa, Artificial
  IGFBP-2 heparin binding domain-containing peptide sequence
KRHIGLEEPKR

SEQ ID NO: 1011 - protein, 11 aa, Artificial
  IGFBP-2 heparin binding domain-containing peptide sequence
RRHIGLEEPKR

SEQ ID NO: 1012 - protein, 11 aa, Artificial
  IGFBP-2 heparin binding domain-containing peptide sequence
HRHIGLEEPKR

SEQ ID NO: 1013 - protein, 11 aa, Artificial
  IGFBP-2 heparin binding domain-containing peptide sequence
KHKIGLEEPKR

SEQ ID NO: 1014 - protein, 11 aa, Artificial
  IGFBP-2 heparin binding domain-containing peptide sequence
RHKIGLEEPKR

SEQ ID NO: 1015 - protein, 11 aa, Artificial
  IGFBP-2 heparin binding domain-containing peptide sequence
HHKIGLEEPKR

SEQ ID NO: 1016 - protein, 11 aa, Artificial
  IGFBP-2 heparin binding domain-containing peptide sequence
KKKIGLEEPKR

SEQ ID NO: 1017 - protein, 11 aa, Artificial
  IGFBP-2 heparin binding domain-containing peptide sequence
RKKIGLEEPKR

SEQ ID NO: 1018 - protein, 11 aa, Artificial
  IGFBP-2 heparin binding domain-containing peptide sequence
HKKIGLEEPKR

SEQ ID NO: 1019 - protein, 11 aa, Artificial
  IGFBP-2 heparin binding domain-containing peptide sequence
KRKIGLEEPKR

SEQ ID NO: 1020 - protein, 11 aa, Artificial
  IGFBP-2 heparin binding domain-containing peptide sequence
RRKIGLEEPKR

SEQ ID NO: 1021 - protein, 11 aa, Artificial
  IGFBP-2 heparin binding domain-containing peptide sequence
HRKIGLEEPKR

SEQ ID NO: 1022 - protein, 11 aa, Artificial
  IGFBP-2 heparin binding domain-containing peptide sequence
KHRIGLEEPKR

SEQ ID NO: 1023 - protein, 11 aa, Artificial
  IGFBP-2 heparin binding domain-containing peptide sequence
RHRIGLEEPKR

SEQ ID NO: 1024 - protein, 11 aa, Artificial
  IGFBP-2 heparin binding domain-containing peptide sequence
HHRIGLEEPKR

SEQ ID NO: 1025 - protein, 11 aa, Artificial
  IGFBP-2 heparin binding domain-containing peptide sequence
KKRIGLEEPKR

SEQ ID NO: 1026 - protein, 11 aa, Artificial
  IGFBP-2 heparin binding domain-containing peptide sequence
RKRIGLEEPKR

SEQ ID NO: 1027 - protein, 11 aa, Artificial
  IGFBP-2 heparin binding domain-containing peptide sequence
HKRIGLEEPKR

SEQ ID NO: 1028 - protein, 11 aa, Artificial
  IGFBP-2 heparin binding domain-containing peptide sequence
KRRIGLEEPKR

SEQ ID NO: 1029 - protein, 11 aa, Artificial
  IGFBP-2 heparin binding domain-containing peptide sequence
RRRIGLEEPKR

SEQ ID NO: 1030 - protein, 11 aa, Artificial
  IGFBP-2 heparin binding domain-containing peptide sequence
HRRIGLEEPKR

SEQ ID NO: 1031 - protein, 11 aa, Artificial
  IGFBP-2 heparin binding domain-containing peptide sequence
KHHVGLEEPKR

SEQ ID NO: 1032 - protein, 11 aa, Artificial
  IGFBP-2 heparin binding domain-containing peptide sequence
RHHVGLEEPKR

SEQ ID NO: 1033 - protein, 11 aa, Artificial
  IGFBP-2 heparin binding domain-containing peptide sequence
HHHVGLEEPKR

SEQ ID NO: 1034 - protein, 11 aa, Artificial
  IGFBP-2 heparin binding domain-containing peptide sequence
KKHVGLEEPKR

SEQ ID NO: 1035 - protein, 11 aa, Artificial
  IGFBP-2 heparin binding domain-containing peptide sequence
RKHVGLEEPKR

SEQ ID NO: 1036 - protein, 11 aa, Artificial
  IGFBP-2 heparin binding domain-containing peptide sequence
HKHVGLEEPKR

SEQ ID NO: 1037 - protein, 11 aa, Artificial
  IGFBP-2 heparin binding domain-containing peptide sequence
KRHVGLEEPKR

SEQ ID NO: 1038 - protein, 11 aa, Artificial
  IGFBP-2 heparin binding domain-containing peptide sequence
RRHVGLEEPKR

SEQ ID NO: 1039 - protein, 11 aa, Artificial
  IGFBP-2 heparin binding domain-containing peptide sequence
HRHVGLEEPKR

SEQ ID NO: 1040 - protein, 11 aa, Artificial
  IGFBP-2 heparin binding domain-containing peptide sequence
KHKVGLEEPKR

SEQ ID NO: 1041 - protein, 11 aa, Artificial
  IGFBP-2 heparin binding domain-containing peptide sequence
RHKVGLEEPKR

SEQ ID NO: 1042 - protein, 11 aa, Artificial
  IGFBP-2 heparin binding domain-containing peptide sequence
HHKVGLEEPKR

SEQ ID NO: 1043 - protein, 11 aa, Artificial
  IGFBP-2 heparin binding domain-containing peptide sequence
KKKVGLEEPKR

SEQ ID NO: 1044 - protein, 11 aa, Artificial
  IGFBP-2 heparin binding domain-containing peptide sequence
RKKVGLEEPKR

SEQ ID NO: 1045 - protein, 11 aa, Artificial
  IGFBP-2 heparin binding domain-containing peptide sequence
HKKVGLEEPKR

SEQ ID NO: 1046 - protein, 11 aa, Artificial
  IGFBP-2 heparin binding domain-containing peptide sequence
KRKVGLEEPKR

SEQ ID NO: 1047 - protein, 11 aa, Artificial
  IGFBP-2 heparin binding domain-containing peptide sequence
RRKVGLEEPKR

SEQ ID NO: 1048 - protein, 11 aa, Artificial
  IGFBP-2 heparin binding domain-containing peptide sequence
HRKVGLEEPKR

SEQ ID NO: 1049 - protein, 11 aa, Artificial
  IGFBP-2 heparin binding domain-containing peptide sequence
KHRVGLEEPKR

SEQ ID NO: 1050 - protein, 11 aa, Artificial
  IGFBP-2 heparin binding domain-containing peptide sequence
RHRVGLEEPKR

SEQ ID NO: 1051 - protein, 11 aa, Artificial
  IGFBP-2 heparin binding domain-containing peptide sequence
HHRVGLEEPKR

SEQ ID NO: 1052 - protein, 11 aa, Artificial
  IGFBP-2 heparin binding domain-containing peptide sequence
KKRVGLEEPKR

SEQ ID NO: 1053 - protein, 11 aa, Artificial
  IGFBP-2 heparin binding domain-containing peptide sequence
RKRVGLEEPKR

SEQ ID NO: 1054 - protein, 11 aa, Artificial
  IGFBP-2 heparin binding domain-containing peptide sequence
HKRVGLEEPKR

SEQ ID NO: 1055 - protein, 11 aa, Artificial
  IGFBP-2 heparin binding domain-containing peptide sequence
KRRVGLEEPKR

SEQ ID NO: 1056 - protein, 11 aa, Artificial
  IGFBP-2 heparin binding domain-containing peptide sequence
RRRVGLEEPKR

SEQ ID NO: 1057 - protein, 11 aa, Artificial
  IGFBP-2 heparin binding domain-containing peptide sequence
HRRVGLEEPKR

SEQ ID NO: 1058 - protein, 11 aa, Artificial
  IGFBP-2 heparin binding domain-containing peptide sequence
KHHLGIEEPKR

SEQ ID NO: 1059 - protein, 11 aa, Artificial
  IGFBP-2 heparin binding domain-containing peptide sequence
RHHLGIEEPKR

SEQ ID NO: 1060 - protein, 11 aa, Artificial
  IGFBP-2 heparin binding domain-containing peptide sequence
HHHLGIEEPKR

SEQ ID NO: 1061 - protein, 11 aa, Artificial
  IGFBP-2 heparin binding domain-containing peptide sequence
KKHLGIEEPKR

SEQ ID NO: 1062 - protein, 11 aa, Artificial
  IGFBP-2 heparin binding domain-containing peptide sequence
RKHLGIEEPKR

SEQ ID NO: 1063 - protein, 11 aa, Artificial
  IGFBP-2 heparin binding domain-containing peptide sequence
HKHLGIEEPKR

SEQ ID NO: 1064 - protein, 11 aa, Artificial
  IGFBP-2 heparin binding domain-containing peptide sequence
KRHLGIEEPKR

SEQ ID NO: 1065 - protein, 11 aa, Artificial
  IGFBP-2 heparin binding domain-containing peptide sequence
RRHLGIEEPKR

SEQ ID NO: 1066 - protein, 11 aa, Artificial
  IGFBP-2 heparin binding domain-containing peptide sequence
HRHLGIEEPKR

SEQ ID NO: 1067 - protein, 11 aa, Artificial
  IGFBP-2 heparin binding domain-containing peptide sequence
KHKLGIEEPKR

SEQ ID NO: 1068 - protein, 11 aa, Artificial
  IGFBP-2 heparin binding domain-containing peptide sequence
RHKLGIEEPKR

SEQ ID NO: 1069 - protein, 11 aa, Artificial
  IGFBP-2 heparin binding domain-containing peptide sequence
HHKLGIEEPKR

SEQ ID NO: 1070 - protein, 11 aa, Artificial
  IGFBP-2 heparin binding domain-containing peptide sequence
KKKLGIEEPKR

SEQ ID NO: 1071 - protein, 11 aa, Artificial
  IGFBP-2 heparin binding domain-containing peptide sequence
RKKLGIEEPKR

SEQ ID NO: 1072 - protein, 11 aa, Artificial
  IGFBP-2 heparin binding domain-containing peptide sequence
HKKLGIEEPKR

SEQ ID NO: 1073 - protein, 11 aa, Artificial
  IGFBP-2 heparin binding domain-containing peptide sequence
KRKLGIEEPKR

SEQ ID NO: 1074 - protein, 11 aa, Artificial
  IGFBP-2 heparin binding domain-containing peptide sequence
RRKLGIEEPKR

SEQ ID NO: 1075 - protein, 11 aa, Artificial
  IGFBP-2 heparin binding domain-containing peptide sequence
HRKLGIEEPKR

SEQ ID NO: 1076 - protein, 11 aa, Artificial
  IGFBP-2 heparin binding domain-containing peptide sequence
KHRLGIEEPKR

SEQ ID NO: 1077 - protein, 11 aa, Artificial
  IGFBP-2 heparin binding domain-containing peptide sequence
RHRLGIEEPKR

SEQ ID NO: 1078 - protein, 11 aa, Artificial
  IGFBP-2 heparin binding domain-containing peptide sequence
HHRLGIEEPKR

SEQ ID NO: 1079 - protein, 11 aa, Artificial
  IGFBP-2 heparin binding domain-containing peptide sequence
KKRLGIEEPKR

SEQ ID NO: 1080 - protein, 11 aa, Artificial
  IGFBP-2 heparin binding domain-containing peptide sequence
RKRLGIEEPKR

SEQ ID NO: 1081 - protein, 11 aa, Artificial
  IGFBP-2 heparin binding domain-containing peptide sequence
HKRLGIEEPKR

SEQ ID NO: 1082 - protein, 11 aa, Artificial
  IGFBP-2 heparin binding domain-containing peptide sequence
KRRLGIEEPKR

SEQ ID NO: 1083 - protein, 11 aa, Artificial
  IGFBP-2 heparin binding domain-containing peptide sequence
RRRLGIEEPKR

SEQ ID NO: 1084 - protein, 11 aa, Artificial
  IGFBP-2 heparin binding domain-containing peptide sequence
HRRLGIEEPKR

SEQ ID NO: 1085 - protein, 11 aa, Artificial
  IGFBP-2 heparin binding domain-containing peptide sequence
KHHIGIEEPKR

SEQ ID NO: 1086 - protein, 11 aa, Artificial
  IGFBP-2 heparin binding domain-containing peptide sequence
RHHIGIEEPKR

SEQ ID NO: 1087 - protein, 11 aa, Artificial
  IGFBP-2 heparin binding domain-containing peptide sequence
HHHIGIEEPKR

SEQ ID NO: 1088 - protein, 11 aa, Artificial
  IGFBP-2 heparin binding domain-containing peptide sequence
KKHIGIEEPKR

SEQ ID NO: 1089 - protein, 11 aa, Artificial
  IGFBP-2 heparin binding domain-containing peptide sequence
RKHIGIEEPKR

SEQ ID NO: 1090 - protein, 11 aa, Artificial
  IGFBP-2 heparin binding domain-containing peptide sequence
HKHIGIEEPKR

SEQ ID NO: 1091 - protein, 11 aa, Artificial
  IGFBP-2 heparin binding domain-containing peptide sequence
KRHIGIEEPKR

SEQ ID NO: 1092 - protein, 11 aa, Artificial
  IGFBP-2 heparin binding domain-containing peptide sequence
RRHIGIEEPKR

SEQ ID NO: 1093 - protein, 11 aa, Artificial
  IGFBP-2 heparin binding domain-containing peptide sequence
HRHIGIEEPKR

SEQ ID NO: 1094 - protein, 11 aa, Artificial
  IGFBP-2 heparin binding domain-containing peptide sequence
KHKIGIEEPKR

SEQ ID NO: 1095 - protein, 11 aa, Artificial
  IGFBP-2 heparin binding domain-containing peptide sequence
RHKIGIEEPKR

SEQ ID NO: 1096 - protein, 11 aa, Artificial
  IGFBP-2 heparin binding domain-containing peptide sequence
HHKIGIEEPKR

SEQ ID NO: 1097 - protein, 11 aa, Artificial
  IGFBP-2 heparin binding domain-containing peptide sequence
KKKIGIEEPKR

SEQ ID NO: 1098 - protein, 11 aa, Artificial
  IGFBP-2 heparin binding domain-containing peptide sequence
RKKIGIEEPKR

SEQ ID NO: 1099 - protein, 11 aa, Artificial
  IGFBP-2 heparin binding domain-containing peptide sequence
HKKIGIEEPKR

SEQ ID NO: 1100 - protein, 11 aa, Artificial
  IGFBP-2 heparin binding domain-containing peptide sequence
KRKIGIEEPKR

SEQ ID NO: 1101 - protein, 11 aa, Artificial
  IGFBP-2 heparin binding domain-containing peptide sequence
RRKIGIEEPKR

SEQ ID NO: 1102 - protein, 11 aa, Artificial
  IGFBP-2 heparin binding domain-containing peptide sequence
HRKIGIEEPKR

SEQ ID NO: 1103 - protein, 11 aa, Artificial
  IGFBP-2 heparin binding domain-containing peptide sequence
KHRIGIEEPKR

SEQ ID NO: 1104 - protein, 11 aa, Artificial
  IGFBP-2 heparin binding domain-containing peptide sequence
RHRIGIEEPKR

SEQ ID NO: 1105 - protein, 11 aa, Artificial
  IGFBP-2 heparin binding domain-containing peptide sequence
HHRIGIEEPKR

SEQ ID NO: 1106 - protein, 11 aa, Artificial
  IGFBP-2 heparin binding domain-containing peptide sequence
KKRIGIEEPKR

SEQ ID NO: 1107 - protein, 11 aa, Artificial
  IGFBP-2 heparin binding domain-containing peptide sequence
RKRIGIEEPKR

SEQ ID NO: 1108 - protein, 11 aa, Artificial
  IGFBP-2 heparin binding domain-containing peptide sequence
HKRIGIEEPKR

SEQ ID NO: 1109 - protein, 11 aa, Artificial
  IGFBP-2 heparin binding domain-containing peptide sequence
KRRIGIEEPKR

SEQ ID NO: 1110 - protein, 11 aa, Artificial
  IGFBP-2 heparin binding domain-containing peptide sequence
RRRIGIEEPKR

SEQ ID NO: 1111 - protein, 11 aa, Artificial
  IGFBP-2 heparin binding domain-containing peptide sequence
HRRIGIEEPKR

SEQ ID NO: 1112 - protein, 11 aa, Artificial
  IGFBP-2 heparin binding domain-containing peptide sequence
KHHVGIEEPKR

SEQ ID NO: 1113 - protein, 11 aa, Artificial
  IGFBP-2 heparin binding domain-containing peptide sequence
RHHVGIEEPKR

SEQ ID NO: 1114 - protein, 11 aa, Artificial
  IGFBP-2 heparin binding domain-containing peptide sequence
HHHVGIEEPKR

SEQ ID NO: 1115 - protein, 11 aa, Artificial
  IGFBP-2 heparin binding domain-containing peptide sequence
KKHVGIEEPKR

SEQ ID NO: 1116 - protein, 11 aa, Artificial
  IGFBP-2 heparin binding domain-containing peptide sequence
RKHVGIEEPKR

SEQ ID NO: 1117 - protein, 11 aa, Artificial
  IGFBP-2 heparin binding domain-containing peptide sequence
HKHVGIEEPKR

SEQ ID NO: 1118 - protein, 11 aa, Artificial
  IGFBP-2 heparin binding domain-containing peptide sequence
KRHVGIEEPKR

SEQ ID NO: 1119 - protein, 11 aa, Artificial
  IGFBP-2 heparin binding domain-containing peptide sequence
RRHVGIEEPKR

SEQ ID NO: 1120 - protein, 11 aa, Artificial
  IGFBP-2 heparin binding domain-containing peptide sequence
HRHVGIEEPKR

SEQ ID NO: 1121 - protein, 11 aa, Artificial
  IGFBP-2 heparin binding domain-containing peptide sequence
KHKVGIEEPKR

SEQ ID NO: 1122 - protein, 11 aa, Artificial
  IGFBP-2 heparin binding domain-containing peptide sequence
RHKVGIEEPKR

SEQ ID NO: 1123 - protein, 11 aa, Artificial
  IGFBP-2 heparin binding domain-containing peptide sequence
HHKVGIEEPKR

SEQ ID NO: 1124 - protein, 11 aa, Artificial
  IGFBP-2 heparin binding domain-containing peptide sequence
KKKVGIEEPKR

SEQ ID NO: 1125 - protein, 11 aa, Artificial
  IGFBP-2 heparin binding domain-containing peptide sequence
RKKVGIEEPKR

SEQ ID NO: 1126 - protein, 11 aa, Artificial
  IGFBP-2 heparin binding domain-containing peptide sequence
HKKVGIEEPKR

SEQ ID NO: 1127 - protein, 11 aa, Artificial
  IGFBP-2 heparin binding domain-containing peptide sequence
KRKVGIEEPKR

SEQ ID NO: 1128 - protein, 11 aa, Artificial
  IGFBP-2 heparin binding domain-containing peptide sequence
RRKVGIEEPKR

SEQ ID NO: 1129 - protein, 11 aa, Artificial
  IGFBP-2 heparin binding domain-containing peptide sequence
HRKVGIEEPKR

SEQ ID NO: 1130 - protein, 11 aa, Artificial
  IGFBP-2 heparin binding domain-containing peptide sequence
KHRVGIEEPKR

SEQ ID NO: 1131 - protein, 11 aa, Artificial
  IGFBP-2 heparin binding domain-containing peptide sequence
RHRVGIEEPKR

SEQ ID NO: 1132 - protein, 11 aa, Artificial
  IGFBP-2 heparin binding domain-containing peptide sequence
HHRVGIEEPKR

SEQ ID NO: 1133 - protein, 11 aa, Artificial
  IGFBP-2 heparin binding domain-containing peptide sequence
KKRVGIEEPKR

SEQ ID NO: 1134 - protein, 11 aa, Artificial
  IGFBP-2 heparin binding domain-containing peptide sequence
RKRVGIEEPKR

SEQ ID NO: 1135 - protein, 11 aa, Artificial
  IGFBP-2 heparin binding domain-containing peptide sequence
HKRVGIEEPKR

SEQ ID NO: 1136 - protein, 11 aa, Artificial
  IGFBP-2 heparin binding domain-containing peptide sequence
KRRVGIEEPKR

SEQ ID NO: 1137 - protein, 11 aa, Artificial
  IGFBP-2 heparin binding domain-containing peptide sequence
RRRVGIEEPKR

SEQ ID NO: 1138 - protein, 11 aa, Artificial
  IGFBP-2 heparin binding domain-containing peptide sequence
HRRVGIEEPKR

SEQ ID NO: 1139 - protein, 11 aa, Artificial
  IGFBP-2 heparin binding domain-containing peptide sequence
KHHLGVEEPKR

SEQ ID NO: 1140 - protein, 11 aa, Artificial
  IGFBP-2 heparin binding domain-containing peptide sequence
RHHLGVEEPKR

SEQ ID NO: 1141 - protein, 11 aa, Artificial
  IGFBP-2 heparin binding domain-containing peptide sequence
HHHLGVEEPKR

SEQ ID NO: 1142 - protein, 11 aa, Artificial
  IGFBP-2 heparin binding domain-containing peptide sequence
KKHLGVEEPKR

SEQ ID NO: 1143 - protein, 11 aa, Artificial
  IGFBP-2 heparin binding domain-containing peptide sequence
RKHLGVEEPKR

SEQ ID NO: 1144 - protein, 11 aa, Artificial
  IGFBP-2 heparin binding domain-containing peptide sequence
HKHLGVEEPKR

SEQ ID NO: 1145 - protein, 11 aa, Artificial
  IGFBP-2 heparin binding domain-containing peptide sequence
KRHLGVEEPKR

SEQ ID NO: 1146 - protein, 11 aa, Artificial
  IGFBP-2 heparin binding domain-containing peptide sequence
RRHLGVEEPKR

SEQ ID NO: 1147 - protein, 11 aa, Artificial
  IGFBP-2 heparin binding domain-containing peptide sequence
HRHLGVEEPKR

SEQ ID NO: 1148 - protein, 11 aa, Artificial
  IGFBP-2 heparin binding domain-containing peptide sequence
KHKLGVEEPKR

SEQ ID NO: 1149 - protein, 11 aa, Artificial
  IGFBP-2 heparin binding domain-containing peptide sequence
RHKLGVEEPKR

SEQ ID NO: 1150 - protein, 11 aa, Artificial
  IGFBP-2 heparin binding domain-containing peptide sequence
HHKLGVEEPKR

SEQ ID NO: 1151 - protein, 11 aa, Artificial
  IGFBP-2 heparin binding domain-containing peptide sequence
KKKLGVEEPKR

SEQ ID NO: 1152 - protein, 11 aa, Artificial
  IGFBP-2 heparin binding domain-containing peptide sequence
RKKLGVEEPKR

SEQ ID NO: 1153 - protein, 11 aa, Artificial
  IGFBP-2 heparin binding domain-containing peptide sequence
HKKLGVEEPKR

SEQ ID NO: 1154 - protein, 11 aa, Artificial
  IGFBP-2 heparin binding domain-containing peptide sequence
KRKLGVEEPKR

SEQ ID NO: 1155 - protein, 11 aa, Artificial
  IGFBP-2 heparin binding domain-containing peptide sequence
RRKLGVEEPKR

SEQ ID NO: 1156 - protein, 11 aa, Artificial
  IGFBP-2 heparin binding domain-containing peptide sequence
HRKLGVEEPKR

SEQ ID NO: 1157 - protein, 11 aa, Artificial
  IGFBP-2 heparin binding domain-containing peptide sequence
KHRLGVEEPKR

SEQ ID NO: 1158 - protein, 11 aa, Artificial
  IGFBP-2 heparin binding domain-containing peptide sequence
RHRLGVEEPKR

SEQ ID NO: 1159 - protein, 11 aa, Artificial
  IGFBP-2 heparin binding domain-containing peptide sequence
HHRLGVEEPKR

SEQ ID NO: 1160 - protein, 11 aa, Artificial
  IGFBP-2 heparin binding domain-containing peptide sequence
KKRLGVEEPKR

SEQ ID NO: 1161 - protein, 11 aa, Artificial
  IGFBP-2 heparin binding domain-containing peptide sequence
RKRLGVEEPKR

SEQ ID NO: 1162 - protein, 11 aa, Artificial
  IGFBP-2 heparin binding domain-containing peptide sequence
HKRLGVEEPKR

SEQ ID NO: 1163 - protein, 11 aa, Artificial
  IGFBP-2 heparin binding domain-containing peptide sequence
KRRLGVEEPKR

SEQ ID NO: 1164 - protein, 11 aa, Artificial
  IGFBP-2 heparin binding domain-containing peptide sequence
RRRLGVEEPKR

SEQ ID NO: 1165 - protein, 11 aa, Artificial
  IGFBP-2 heparin binding domain-containing peptide sequence
HRRLGVEEPKR

SEQ ID NO: 1166 - protein, 11 aa, Artificial
  IGFBP-2 heparin binding domain-containing peptide sequence
KHHIGVEEPKR

SEQ ID NO: 1167 - protein, 11 aa, Artificial
  IGFBP-2 heparin binding domain-containing peptide sequence
RHHIGVEEPKR

SEQ ID NO: 1168 - protein, 11 aa, Artificial
  IGFBP-2 heparin binding domain-containing peptide sequence
HHHIGVEEPKR

SEQ ID NO: 1169 - protein, 11 aa, Artificial
  IGFBP-2 heparin binding domain-containing peptide sequence
KKHIGVEEPKR

SEQ ID NO: 1170 - protein, 11 aa, Artificial
  IGFBP-2 heparin binding domain-containing peptide sequence
RKHIGVEEPKR

SEQ ID NO: 1171 - protein, 11 aa, Artificial
  IGFBP-2 heparin binding domain-containing peptide sequence
HKHIGVEEPKR

SEQ ID NO: 1172 - protein, 11 aa, Artificial
  IGFBP-2 heparin binding domain-containing peptide sequence
KRHIGVEEPKR

SEQ ID NO: 1173 - protein, 11 aa, Artificial
  IGFBP-2 heparin binding domain-containing peptide sequence
RRHIGVEEPKR

SEQ ID NO: 1174 - protein, 11 aa, Artificial
  IGFBP-2 heparin binding domain-containing peptide sequence
HRHIGVEEPKR

SEQ ID NO: 1175 - protein, 11 aa, Artificial
  IGFBP-2 heparin binding domain-containing peptide sequence
KHKIGVEEPKR

SEQ ID NO: 1176 - protein, 11 aa, Artificial
  IGFBP-2 heparin binding domain-containing peptide sequence
RHKIGVEEPKR

SEQ ID NO: 1177 - protein, 11 aa, Artificial
  IGFBP-2 heparin binding domain-containing peptide sequence
HHKIGVEEPKR

SEQ ID NO: 1178 - protein, 11 aa, Artificial
  IGFBP-2 heparin binding domain-containing peptide sequence
KKKIGVEEPKR

SEQ ID NO: 1179 - protein, 11 aa, Artificial
  IGFBP-2 heparin binding domain-containing peptide sequence
RKKIGVEEPKR

SEQ ID NO: 1180 - protein, 11 aa, Artificial
  IGFBP-2 heparin binding domain-containing peptide sequence
HKKIGVEEPKR

SEQ ID NO: 1181 - protein, 11 aa, Artificial
  IGFBP-2 heparin binding domain-containing peptide sequence
KRKIGVEEPKR

SEQ ID NO: 1182 - protein, 11 aa, Artificial
  IGFBP-2 heparin binding domain-containing peptide sequence
RRKIGVEEPKR

SEQ ID NO: 1183 - protein, 11 aa, Artificial
  IGFBP-2 heparin binding domain-containing peptide sequence
HRKIGVEEPKR

SEQ ID NO: 1184 - protein, 11 aa, Artificial
  IGFBP-2 heparin binding domain-containing peptide sequence
KHRIGVEEPKR

SEQ ID NO: 1185 - protein, 11 aa, Artificial
  IGFBP-2 heparin binding domain-containing peptide sequence
RHRIGVEEPKR

SEQ ID NO: 1186 - protein, 11 aa, Artificial
  IGFBP-2 heparin binding domain-containing peptide sequence
HHRIGVEEPKR

SEQ ID NO: 1187 - protein, 11 aa, Artificial
  IGFBP-2 heparin binding domain-containing peptide sequence
KKRIGVEEPKR

SEQ ID NO: 1188 - protein, 11 aa, Artificial
  IGFBP-2 heparin binding domain-containing peptide sequence
RKRIGVEEPKR

SEQ ID NO: 1189 - protein, 11 aa, Artificial
  IGFBP-2 heparin binding domain-containing peptide sequence
HKRIGVEEPKR

SEQ ID NO: 1190 - protein, 11 aa, Artificial
  IGFBP-2 heparin binding domain-containing peptide sequence
KRRIGVEEPKR

SEQ ID NO: 1191 - protein, 11 aa, Artificial
  IGFBP-2 heparin binding domain-containing peptide sequence
RRRIGVEEPKR

SEQ ID NO: 1192 - protein, 11 aa, Artificial
  IGFBP-2 heparin binding domain-containing peptide sequence
HRRIGVEEPKR

SEQ ID NO: 1193 - protein, 11 aa, Artificial
  IGFBP-2 heparin binding domain-containing peptide sequence
KHHVGVEEPKR

SEQ ID NO: 1194 - protein, 11 aa, Artificial
  IGFBP-2 heparin binding domain-containing peptide sequence
RHHVGVEEPKR

SEQ ID NO: 1195 - protein, 11 aa, Artificial
  IGFBP-2 heparin binding domain-containing peptide sequence
HHHVGVEEPKR

SEQ ID NO: 1196 - protein, 11 aa, Artificial
  IGFBP-2 heparin binding domain-containing peptide sequence
KKHVGVEEPKR

SEQ ID NO: 1197 - protein, 11 aa, Artificial
  IGFBP-2 heparin binding domain-containing peptide sequence
RKHVGVEEPKR

SEQ ID NO: 1198 - protein, 11 aa, Artificial
  IGFBP-2 heparin binding domain-containing peptide sequence
HKHVGVEEPKR

SEQ ID NO: 1199 - protein, 11 aa, Artificial
  IGFBP-2 heparin binding domain-containing peptide sequence
KRHVGVEEPKR

SEQ ID NO: 1200 - protein, 11 aa, Artificial
  IGFBP-2 heparin binding domain-containing peptide sequence
RRHVGVEEPKR

SEQ ID NO: 1201 - protein, 11 aa, Artificial
  IGFBP-2 heparin binding domain-containing peptide sequence
HRHVGVEEPKR

SEQ ID NO: 1202 - protein, 11 aa, Artificial
  IGFBP-2 heparin binding domain-containing peptide sequence
KHKVGVEEPKR

SEQ ID NO: 1203 - protein, 11 aa, Artificial
  IGFBP-2 heparin binding domain-containing peptide sequence
RHKVGVEEPKR

SEQ ID NO: 1204 - protein, 11 aa, Artificial
  IGFBP-2 heparin binding domain-containing peptide sequence
HHKVGVEEPKR

SEQ ID NO: 1205 - protein, 11 aa, Artificial
  IGFBP-2 heparin binding domain-containing peptide sequence
KKKVGVEEPKR

SEQ ID NO: 1206 - protein, 11 aa, Artificial
  IGFBP-2 heparin binding domain-containing peptide sequence
RKKVGVEEPKR

SEQ ID NO: 1207 - protein, 11 aa, Artificial
  IGFBP-2 heparin binding domain-containing peptide sequence
HKKVGVEEPKR

SEQ ID NO: 1208 - protein, 11 aa, Artificial
  IGFBP-2 heparin binding domain-containing peptide sequence
KRKVGVEEPKR

SEQ ID NO: 1209 - protein, 11 aa, Artificial
  IGFBP-2 heparin binding domain-containing peptide sequence
RRKVGVEEPKR

SEQ ID NO: 1210 - protein, 11 aa, Artificial
  IGFBP-2 heparin binding domain-containing peptide sequence
HRKVGVEEPKR

SEQ ID NO: 1211 - protein, 11 aa, Artificial
  IGFBP-2 heparin binding domain-containing peptide sequence
KHRVGVEEPKR

SEQ ID NO: 1212 - protein, 11 aa, Artificial
  IGFBP-2 heparin binding domain-containing peptide sequence
RHRVGVEEPKR

SEQ ID NO: 1213 - protein, 11 aa, Artificial
  IGFBP-2 heparin binding domain-containing peptide sequence
HHRVGVEEPKR

SEQ ID NO: 1214 - protein, 11 aa, Artificial
  IGFBP-2 heparin binding domain-containing peptide sequence
KKRVGVEEPKR

SEQ ID NO: 1215 - protein, 11 aa, Artificial
  IGFBP-2 heparin binding domain-containing peptide sequence
RKRVGVEEPKR

SEQ ID NO: 1216 - protein, 11 aa, Artificial
  IGFBP-2 heparin binding domain-containing peptide sequence
HKRVGVEEPKR

SEQ ID NO: 1217 - protein, 11 aa, Artificial
  IGFBP-2 heparin binding domain-containing peptide sequence
KRRVGVEEPKR

SEQ ID NO: 1218 - protein, 11 aa, Artificial
  IGFBP-2 heparin binding domain-containing peptide sequence
RRRVGVEEPKR

SEQ ID NO: 1219 - protein, 11 aa, Artificial
  IGFBP-2 heparin binding domain-containing peptide sequence
HRRVGVEEPKR

SEQ ID NO: 1220 - protein, 11 aa, Artificial
  IGFBP-2 heparin binding domain-containing peptide sequence
KHHLGLNEPKR

SEQ ID NO: 1221 - protein, 11 aa, Artificial
  IGFBP-2 heparin binding domain-containing peptide sequence
RHHLGLNEPKR

SEQ ID NO: 1222 - protein, 11 aa, Artificial
  IGFBP-2 heparin binding domain-containing peptide sequence
HHHLGLNEPKR

SEQ ID NO: 1223 - protein, 11 aa, Artificial
  IGFBP-2 heparin binding domain-containing peptide sequence
KKHLGLNEPKR

SEQ ID NO: 1224 - protein, 11 aa, Artificial
  IGFBP-2 heparin binding domain-containing peptide sequence
RKHLGLNEPKR

SEQ ID NO: 1225 - protein, 11 aa, Artificial
  IGFBP-2 heparin binding domain-containing peptide sequence
HKHLGLNEPKR

SEQ ID NO: 1226 - protein, 11 aa, Artificial
  IGFBP-2 heparin binding domain-containing peptide sequence
KRHLGLNEPKR

SEQ ID NO: 1227 - protein, 11 aa, Artificial
  IGFBP-2 heparin binding domain-containing peptide sequence
RRHLGLNEPKR

SEQ ID NO: 1228 - protein, 11 aa, Artificial
  IGFBP-2 heparin binding domain-containing peptide sequence
HRHLGLNEPKR

SEQ ID NO: 1229 - protein, 11 aa, Artificial
  IGFBP-2 heparin binding domain-containing peptide sequence
KHKLGLNEPKR

SEQ ID NO: 1230 - protein, 11 aa, Artificial
  IGFBP-2 heparin binding domain-containing peptide sequence
RHKLGLNEPKR

SEQ ID NO: 1231 - protein, 11 aa, Artificial
  IGFBP-2 heparin binding domain-containing peptide sequence
HHKLGLNEPKR

SEQ ID NO: 1232 - protein, 11 aa, Artificial
  IGFBP-2 heparin binding domain-containing peptide sequence
KKKLGLNEPKR

SEQ ID NO: 1233 - protein, 11 aa, Artificial
  IGFBP-2 heparin binding domain-containing peptide sequence
RKKLGLNEPKR

SEQ ID NO: 1234 - protein, 11 aa, Artificial
  IGFBP-2 heparin binding domain-containing peptide sequence
HKKLGLNEPKR

SEQ ID NO: 1235 - protein, 11 aa, Artificial
  IGFBP-2 heparin binding domain-containing peptide sequence
KRKLGLNEPKR

SEQ ID NO: 1236 - protein, 11 aa, Artificial
  IGFBP-2 heparin binding domain-containing peptide sequence
RRKLGLNEPKR

SEQ ID NO: 1237 - protein, 11 aa, Artificial
  IGFBP-2 heparin binding domain-containing peptide sequence
HRKLGLNEPKR

SEQ ID NO: 1238 - protein, 11 aa, Artificial
  IGFBP-2 heparin binding domain-containing peptide sequence
KHRLGLNEPKR

SEQ ID NO: 1239 - protein, 11 aa, Artificial
  IGFBP-2 heparin binding domain-containing peptide sequence
RHRLGLNEPKR

SEQ ID NO: 1240 - protein, 11 aa, Artificial
  IGFBP-2 heparin binding domain-containing peptide sequence
HHRLGLNEPKR

SEQ ID NO: 1241 - protein, 11 aa, Artificial
  IGFBP-2 heparin binding domain-containing peptide sequence
KKRLGLNEPKR

SEQ ID NO: 1242 - protein, 11 aa, Artificial
  IGFBP-2 heparin binding domain-containing peptide sequence
RKRLGLNEPKR

SEQ ID NO: 1243 - protein, 11 aa, Artificial
  IGFBP-2 heparin binding domain-containing peptide sequence
HKRLGLNEPKR

SEQ ID NO: 1244 - protein, 11 aa, Artificial
  IGFBP-2 heparin binding domain-containing peptide sequence
KRRLGLNEPKR

SEQ ID NO: 1245 - protein, 11 aa, Artificial
  IGFBP-2 heparin binding domain-containing peptide sequence
RRRLGLNEPKR

SEQ ID NO: 1246 - protein, 11 aa, Artificial
  IGFBP-2 heparin binding domain-containing peptide sequence
HRRLGLNEPKR

SEQ ID NO: 1247 - protein, 10 aa, Artificial
  IGFBP-2 heparin binding domain-containing peptide sequence
KHHIGLNPKR

SEQ ID NO: 1248 - protein, 11 aa, Artificial
  IGFBP-2 heparin binding domain-containing peptide sequence
RHHIGLNEPKR

SEQ ID NO: 1249 - protein, 11 aa, Artificial
  IGFBP-2 heparin binding domain-containing peptide sequence
HHHIGLNEPKR

SEQ ID NO: 1250 - protein, 11 aa, Artificial
  IGFBP-2 heparin binding domain-containing peptide sequence
KKHIGLNEPKR

SEQ ID NO: 1251 - protein, 11 aa, Artificial
  IGFBP-2 heparin binding domain-containing peptide sequence
RKHIGLNEPKR

SEQ ID NO: 1252 - protein, 11 aa, Artificial
  IGFBP-2 heparin binding domain-containing peptide sequence
HKHIGLNEPKR

SEQ ID NO: 1253 - protein, 11 aa, Artificial
  IGFBP-2 heparin binding domain-containing peptide sequence
KRHIGLNEPKR

SEQ ID NO: 1254 - protein, 11 aa, Artificial
  IGFBP-2 heparin binding domain-containing peptide sequence
RRHIGLNEPKR

SEQ ID NO: 1255 - protein, 11 aa, Artificial
  IGFBP-2 heparin binding domain-containing peptide sequence
HRHIGLNEPKR

SEQ ID NO: 1256 - protein, 11 aa, Artificial
  IGFBP-2 heparin binding domain-containing peptide sequence
KHKIGLNEPKR

SEQ ID NO: 1257 - protein, 11 aa, Artificial
  IGFBP-2 heparin binding domain-containing peptide sequence
RHKIGLNEPKR

SEQ ID NO: 1258 - protein, 11 aa, Artificial
  IGFBP-2 heparin binding domain-containing peptide sequence
HHKIGLNEPKR

SEQ ID NO: 1259 - protein, 11 aa, Artificial
  IGFBP-2 heparin binding domain-containing peptide sequence
KKKIGLNEPKR

SEQ ID NO: 1260 - protein, 11 aa, Artificial
  IGFBP-2 heparin binding domain-containing peptide sequence
RKKIGLNEPKR

SEQ ID NO: 1261 - protein, 11 aa, Artificial
  IGFBP-2 heparin binding domain-containing peptide sequence
HKKIGLNEPKR

SEQ ID NO: 1262 - protein, 11 aa, Artificial
  IGFBP-2 heparin binding domain-containing peptide sequence
KRKIGLNEPKR

SEQ ID NO: 1263 - protein, 11 aa, Artificial
  IGFBP-2 heparin binding domain-containing peptide sequence
RRKIGLNEPKR

SEQ ID NO: 1264 - protein, 11 aa, Artificial
  IGFBP-2 heparin binding domain-containing peptide sequence
HRKIGLNEPKR

SEQ ID NO: 1265 - protein, 11 aa, Artificial
  IGFBP-2 heparin binding domain-containing peptide sequence
KHRIGLNEPKR

SEQ ID NO: 1266 - protein, 11 aa, Artificial
  IGFBP-2 heparin binding domain-containing peptide sequence
RHRIGLNEPKR

SEQ ID NO: 1267 - protein, 11 aa, Artificial
  IGFBP-2 heparin binding domain-containing peptide sequence
HHRIGLNEPKR

SEQ ID NO: 1268 - protein, 11 aa, Artificial
  IGFBP-2 heparin binding domain-containing peptide sequence
KKRIGLNEPKR

SEQ ID NO: 1269 - protein, 11 aa, Artificial
  IGFBP-2 heparin binding domain-containing peptide sequence
RKRIGLNEPKR

SEQ ID NO: 1270 - protein, 11 aa, Artificial
  IGFBP-2 heparin binding domain-containing peptide sequence
HKRIGLNEPKR

SEQ ID NO: 1271 - protein, 11 aa, Artificial
  IGFBP-2 heparin binding domain-containing peptide sequence
KRRIGLNEPKR

SEQ ID NO: 1272 - protein, 11 aa, Artificial
  IGFBP-2 heparin binding domain-containing peptide sequence
RRRIGLNEPKR

SEQ ID NO: 1273 - protein, 11 aa, Artificial
  IGFBP-2 heparin binding domain-containing peptide sequence
HRRIGLNEPKR

SEQ ID NO: 1274 - protein, 11 aa, Artificial
  IGFBP-2 heparin binding domain-containing peptide sequence
KHHVGLNEPKR

SEQ ID NO: 1275 - protein, 11 aa, Artificial
  IGFBP-2 heparin binding domain-containing peptide sequence
RHHVGLNEPKR

SEQ ID NO: 1276 - protein, 11 aa, Artificial
  IGFBP-2 heparin binding domain-containing peptide sequence
HHHVGLNEPKR

SEQ ID NO: 1277 - protein, 11 aa, Artificial
  IGFBP-2 heparin binding domain-containing peptide sequence
KKHVGLNEPKR

SEQ ID NO: 1278 - protein, 11 aa, Artificial
  IGFBP-2 heparin binding domain-containing peptide sequence
RKHVGLNEPKR

SEQ ID NO: 1279 - protein, 11 aa, Artificial
  IGFBP-2 heparin binding domain-containing peptide sequence
HKHVGLNEPKR

SEQ ID NO: 1280 - protein, 11 aa, Artificial
  IGFBP-2 heparin binding domain-containing peptide sequence
KRHVGLNEPKR

SEQ ID NO: 1281 - protein, 11 aa, Artificial
  IGFBP-2 heparin binding domain-containing peptide sequence
RRHVGLNEPKR

SEQ ID NO: 1282 - protein, 11 aa, Artificial
  IGFBP-2 heparin binding domain-containing peptide sequence
HRHVGLNEPKR

SEQ ID NO: 1283 - protein, 11 aa, Artificial
  IGFBP-2 heparin binding domain-containing peptide sequence
KHKVGLNEPKR

SEQ ID NO: 1284 - protein, 11 aa, Artificial
  IGFBP-2 heparin binding domain-containing peptide sequence
RHKVGLNEPKR

SEQ ID NO: 1285 - protein, 11 aa, Artificial
  IGFBP-2 heparin binding domain-containing peptide sequence
HHKVGLNEPKR

SEQ ID NO: 1286 - protein, 11 aa, Artificial
  IGFBP-2 heparin binding domain-containing peptide sequence
KKKVGLNEPKR

SEQ ID NO: 1287 - protein, 11 aa, Artificial
  IGFBP-2 heparin binding domain-containing peptide sequence
RKKVGLNEPKR

SEQ ID NO: 1288 - protein, 11 aa, Artificial
  IGFBP-2 heparin binding domain-containing peptide sequence
HKKVGLNEPKR

SEQ ID NO: 1289 - protein, 11 aa, Artificial
  IGFBP-2 heparin binding domain-containing peptide sequence
KRKVGLNEPKR

SEQ ID NO: 1290 - protein, 11 aa, Artificial
  IGFBP-2 heparin binding domain-containing peptide sequence
RRKVGLNEPKR

SEQ ID NO: 1291 - protein, 11 aa, Artificial
  IGFBP-2 heparin binding domain-containing peptide sequence
HRKVGLNEPKR

SEQ ID NO: 1292 - protein, 11 aa, Artificial
  IGFBP-2 heparin binding domain-containing peptide sequence
KHRVGLNEPKR

SEQ ID NO: 1293 - protein, 11 aa, Artificial
  IGFBP-2 heparin binding domain-containing peptide sequence
RHRVGLNEPKR

SEQ ID NO: 1294 - protein, 11 aa, Artificial
  IGFBP-2 heparin binding domain-containing peptide sequence
HHRVGLNEPKR

SEQ ID NO: 1295 - protein, 11 aa, Artificial
  IGFBP-2 heparin binding domain-containing peptide sequence
KKRVGLNEPKR

SEQ ID NO: 1296 - protein, 11 aa, Artificial
  IGFBP-2 heparin binding domain-containing peptide sequence
RKRVGLNEPKR

SEQ ID NO: 1297 - protein, 11 aa, Artificial
  IGFBP-2 heparin binding domain-containing peptide sequence
HKRVGLNEPKR

SEQ ID NO: 1298 - protein, 11 aa, Artificial
  IGFBP-2 heparin binding domain-containing peptide sequence
KRRVGLNEPKR

SEQ ID NO: 1299 - protein, 11 aa, Artificial
  IGFBP-2 heparin binding domain-containing peptide sequence
RRRVGLNEPKR

SEQ ID NO: 1300 - protein, 11 aa, Artificial
  IGFBP-2 heparin binding domain-containing peptide sequence
HRRVGLNEPKR

SEQ ID NO: 1301 - protein, 11 aa, Artificial
  IGFBP-2 heparin binding domain-containing peptide sequence
KHHLGINEPKR

SEQ ID NO: 1302 - protein, 11 aa, Artificial
  IGFBP-2 heparin binding domain-containing peptide sequence
RHHLGINEPKR

SEQ ID NO: 1303 - protein, 11 aa, Artificial
  IGFBP-2 heparin binding domain-containing peptide sequence
HHHLGINEPKR

SEQ ID NO: 1304 - protein, 11 aa, Artificial
  IGFBP-2 heparin binding domain-containing peptide sequence
KKHLGINEPKR

SEQ ID NO: 1305 - protein, 11 aa, Artificial
  IGFBP-2 heparin binding domain-containing peptide sequence
RKHLGINEPKR

SEQ ID NO: 1306 - protein, 11 aa, Artificial
  IGFBP-2 heparin binding domain-containing peptide sequence
HKHLGINEPKR

SEQ ID NO: 1307 - protein, 11 aa, Artificial
  IGFBP-2 heparin binding domain-containing peptide sequence
KRHLGINEPKR

SEQ ID NO: 1308 - protein, 11 aa, Artificial
  IGFBP-2 heparin binding domain-containing peptide sequence
RRHLGINEPKR

SEQ ID NO: 1309 - protein, 11 aa, Artificial
  IGFBP-2 heparin binding domain-containing peptide sequence
HRHLGINEPKR

SEQ ID NO: 1310 - protein, 11 aa, Artificial
  IGFBP-2 heparin binding domain-containing peptide sequence
KHKLGINEPKR

SEQ ID NO: 1311 - protein, 11 aa, Artificial
  IGFBP-2 heparin binding domain-containing peptide sequence
RHKLGINEPKR

SEQ ID NO: 1312 - protein, 11 aa, Artificial
  IGFBP-2 heparin binding domain-containing peptide sequence
HHKLGINEPKR

SEQ ID NO: 1313 - protein, 11 aa, Artificial
  IGFBP-2 heparin binding domain-containing peptide sequence
KKKLGINEPKR

SEQ ID NO: 1314 - protein, 11 aa, Artificial
  IGFBP-2 heparin binding domain-containing peptide sequence
RKKLGINEPKR

SEQ ID NO: 1315 - protein, 11 aa, Artificial
  IGFBP-2 heparin binding domain-containing peptide sequence
HKKLGINEPKR

SEQ ID NO: 1316 - protein, 11 aa, Artificial
  IGFBP-2 heparin binding domain-containing peptide sequence
KRKLGINEPKR

SEQ ID NO: 1317 - protein, 11 aa, Artificial
  IGFBP-2 heparin binding domain-containing peptide sequence
RRKLGINEPKR

SEQ ID NO: 1318 - protein, 11 aa, Artificial
  IGFBP-2 heparin binding domain-containing peptide sequence
HRKLGINEPKR

SEQ ID NO: 1319 - protein, 11 aa, Artificial
  IGFBP-2 heparin binding domain-containing peptide sequence
KHRLGINEPKR

SEQ ID NO: 1320 - protein, 11 aa, Artificial
  IGFBP-2 heparin binding domain-containing peptide sequence
RHRLGINEPKR

SEQ ID NO: 1321 - protein, 11 aa, Artificial
  IGFBP-2 heparin binding domain-containing peptide sequence
HHRLGINEPKR

SEQ ID NO: 1322 - protein, 11 aa, Artificial
  IGFBP-2 heparin binding domain-containing peptide sequence
KKRLGINEPKR

SEQ ID NO: 1323 - protein, 11 aa, Artificial
  IGFBP-2 heparin binding domain-containing peptide sequence
RKRLGINEPKR

SEQ ID NO: 1324 - protein, 11 aa, Artificial
  IGFBP-2 heparin binding domain-containing peptide sequence
HKRLGINEPKR

SEQ ID NO: 1325 - protein, 11 aa, Artificial
  IGFBP-2 heparin binding domain-containing peptide sequence
KRRLGINEPKR

SEQ ID NO: 1326 - protein, 11 aa, Artificial
  IGFBP-2 heparin binding domain-containing peptide sequence
RRRLGINEPKR

SEQ ID NO: 1327 - protein, 11 aa, Artificial
  IGFBP-2 heparin binding domain-containing peptide sequence
HRRLGINEPKR

SEQ ID NO: 1328 - protein, 11 aa, Artificial
  IGFBP-2 heparin binding domain-containing peptide sequence
KHHIGIENPKR

SEQ ID NO: 1329 - protein, 11 aa, Artificial
  IGFBP-2 heparin binding domain-containing peptide sequence
RHHIGINEPKR

SEQ ID NO: 1330 - protein, 11 aa, Artificial
  IGFBP-2 heparin binding domain-containing peptide sequence
HHHIGINEPKR

SEQ ID NO: 1331 - protein, 11 aa, Artificial
  IGFBP-2 heparin binding domain-containing peptide sequence
KKHIGINEPKR

SEQ ID NO: 1332 - protein, 11 aa, Artificial
  IGFBP-2 heparin binding domain-containing peptide sequence
RKHIGINEPKR

SEQ ID NO: 1333 - protein, 11 aa, Artificial
  IGFBP-2 heparin binding domain-containing peptide sequence
HKHIGINEPKR

SEQ ID NO: 1334 - protein, 11 aa, Artificial
  IGFBP-2 heparin binding domain-containing peptide sequence
KRHIGINEPKR

SEQ ID NO: 1335 - protein, 11 aa, Artificial
  IGFBP-2 heparin binding domain-containing peptide sequence
RRHIGINEPKR

SEQ ID NO: 1336 - protein, 11 aa, Artificial
  IGFBP-2 heparin binding domain-containing peptide sequence
HRHIGINEPKR

SEQ ID NO: 1337 - protein, 11 aa, Artificial
  IGFBP-2 heparin binding domain-containing peptide sequence
KHKIGINEPKR

SEQ ID NO: 1338 - protein, 11 aa, Artificial
  IGFBP-2 heparin binding domain-containing peptide sequence
RHKIGINEPKR

SEQ ID NO: 1339 - protein, 11 aa, Artificial
  IGFBP-2 heparin binding domain-containing peptide sequence
HHKIGINEPKR

SEQ ID NO: 1340 - protein, 11 aa, Artificial
  IGFBP-2 heparin binding domain-containing peptide sequence
KKKIGINEPKR

SEQ ID NO: 1341 - protein, 11 aa, Artificial
  IGFBP-2 heparin binding domain-containing peptide sequence
RKKIGINEPKR

SEQ ID NO: 1342 - protein, 11 aa, Artificial
  IGFBP-2 heparin binding domain-containing peptide sequence
HKKIGINEPKR

SEQ ID NO: 1343 - protein, 11 aa, Artificial
  IGFBP-2 heparin binding domain-containing peptide sequence
KRKIGINEPKR

SEQ ID NO: 1344 - protein, 11 aa, Artificial
  IGFBP-2 heparin binding domain-containing peptide sequence
RRKIGINEPKR

SEQ ID NO: 1345 - protein, 11 aa, Artificial
  IGFBP-2 heparin binding domain-containing peptide sequence
HRKIGINEPKR

SEQ ID NO: 1346 - protein, 11 aa, Artificial
  IGFBP-2 heparin binding domain-containing peptide sequence
KHRIGINEPKR

SEQ ID NO: 1347 - protein, 11 aa, Artificial
  IGFBP-2 heparin binding domain-containing peptide sequence
RHRIGINEPKR

SEQ ID NO: 1348 - protein, 11 aa, Artificial
  IGFBP-2 heparin binding domain-containing peptide sequence
HHRIGINEPKR

SEQ ID NO: 1349 - protein, 11 aa, Artificial
  IGFBP-2 heparin binding domain-containing peptide sequence
KKRIGINEPKR

SEQ ID NO: 1350 - protein, 11 aa, Artificial
  IGFBP-2 heparin binding domain-containing peptide sequence
RKRIGINEPKR

SEQ ID NO: 1351 - protein, 11 aa, Artificial
  IGFBP-2 heparin binding domain-containing peptide sequence
HKRIGINEPKR

SEQ ID NO: 1352 - protein, 11 aa, Artificial
  IGFBP-2 heparin binding domain-containing peptide sequence
KRRIGINEPKR

SEQ ID NO: 1353 - protein, 11 aa, Artificial
  IGFBP-2 heparin binding domain-containing peptide sequence
RRRIGINEPKR

SEQ ID NO: 1354 - protein, 11 aa, Artificial
  IGFBP-2 heparin binding domain-containing peptide sequence
HRRIGINEPKR

SEQ ID NO: 1355 - protein, 11 aa, Artificial
  IGFBP-2 heparin binding domain-containing peptide sequence
KHHVGINEPKR

SEQ ID NO: 1356 - protein, 11 aa, Artificial
  IGFBP-2 heparin binding domain-containing peptide sequence
RHHVGINEPKR

SEQ ID NO: 1357 - protein, 11 aa, Artificial
  IGFBP-2 heparin binding domain-containing peptide sequence
HHHVGINEPKR

SEQ ID NO: 1358 - protein, 11 aa, Artificial
  IGFBP-2 heparin binding domain-containing peptide sequence
KKHVGINEPKR

SEQ ID NO: 1359 - protein, 11 aa, Artificial
  IGFBP-2 heparin binding domain-containing peptide sequence
RKHVGINEPKR

SEQ ID NO: 1360 - protein, 11 aa, Artificial
  IGFBP-2 heparin binding domain-containing peptide sequence
HKHVGINEPKR

SEQ ID NO: 1361 - protein, 11 aa, Artificial
  IGFBP-2 heparin binding domain-containing peptide sequence
KRHVGINEPKR

SEQ ID NO: 1362 - protein, 11 aa, Artificial
  IGFBP-2 heparin binding domain-containing peptide sequence
RRHVGINEPKR

SEQ ID NO: 1363 - protein, 11 aa, Artificial
  IGFBP-2 heparin binding domain-containing peptide sequence
HRHVGINEPKR

SEQ ID NO: 1364 - protein, 11 aa, Artificial
  IGFBP-2 heparin binding domain-containing peptide sequence
KHKVGINEPKR

SEQ ID NO: 1365 - protein, 11 aa, Artificial
  IGFBP-2 heparin binding domain-containing peptide sequence
RHKVGINEPKR

SEQ ID NO: 1366 - protein, 11 aa, Artificial
  IGFBP-2 heparin binding domain-containing peptide sequence
HHKVGINEPKR

SEQ ID NO: 1367 - protein, 11 aa, Artificial
  IGFBP-2 heparin binding domain-containing peptide sequence
KKKVGINEPKR

SEQ ID NO: 1368 - protein, 11 aa, Artificial
  IGFBP-2 heparin binding domain-containing peptide sequence
RKKVGINEPKR

SEQ ID NO: 1369 - protein, 11 aa, Artificial
  IGFBP-2 heparin binding domain-containing peptide sequence
HKKVGINEPKR

SEQ ID NO: 1370 - protein, 11 aa, Artificial
  IGFBP-2 heparin binding domain-containing peptide sequence
KRKVGINEPKR

SEQ ID NO: 1371 - protein, 11 aa, Artificial
  IGFBP-2 heparin binding domain-containing peptide sequence
RRKVGINEPKR

SEQ ID NO: 1372 - protein, 11 aa, Artificial
  IGFBP-2 heparin binding domain-containing peptide sequence
HRKVGINEPKR

SEQ ID NO: 1373 - protein, 11 aa, Artificial
  IGFBP-2 heparin binding domain-containing peptide sequence
KHRVGINEPKR

SEQ ID NO: 1374 - protein, 11 aa, Artificial
  IGFBP-2 heparin binding domain-containing peptide sequence
RHRVGINEPKR

SEQ ID NO: 1375 - protein, 11 aa, Artificial
  IGFBP-2 heparin binding domain-containing peptide sequence
HHRVGINEPKR

SEQ ID NO: 1376 - protein, 11 aa, Artificial
  IGFBP-2 heparin binding domain-containing peptide sequence
KKRVGINEPKR

SEQ ID NO: 1377 - protein, 11 aa, Artificial
  IGFBP-2 heparin binding domain-containing peptide sequence
RKRVGINEPKR

SEQ ID NO: 1378 - protein, 11 aa, Artificial
  IGFBP-2 heparin binding domain-containing peptide sequence
HKRVGINEPKR

SEQ ID NO: 1379 - protein, 11 aa, Artificial
  IGFBP-2 heparin binding domain-containing peptide sequence
KRRVGINEPKR

SEQ ID NO: 1380 - protein, 11 aa, Artificial
  IGFBP-2 heparin binding domain-containing peptide sequence
RRRVGINEPKR

SEQ ID NO: 1381 - protein, 11 aa, Artificial
  IGFBP-2 heparin binding domain-containing peptide sequence
HRRVGINEPKR

SEQ ID NO: 1382 - protein, 11 aa, Artificial
  IGFBP-2 heparin binding domain-containing peptide sequence
KHHLGVNEPKR

SEQ ID NO: 1383 - protein, 11 aa, Artificial
  IGFBP-2 heparin binding domain-containing peptide sequence
RHHLGVNEPKR

SEQ ID NO: 1384 - protein, 11 aa, Artificial
  IGFBP-2 heparin binding domain-containing peptide sequence
HHHLGVNEPKR

SEQ ID NO: 1385 - protein, 11 aa, Artificial
  IGFBP-2 heparin binding domain-containing peptide sequence
KKHLGVNEPKR

SEQ ID NO: 1386 - protein, 11 aa, Artificial
  IGFBP-2 heparin binding domain-containing peptide sequence
RKHLGVNEPKR

SEQ ID NO: 1387 - protein, 11 aa, Artificial
  IGFBP-2 heparin binding domain-containing peptide sequence
HKHLGVNEPKR

SEQ ID NO: 1388 - protein, 11 aa, Artificial
  IGFBP-2 heparin binding domain-containing peptide sequence
KRHLGVNEPKR

SEQ ID NO: 1389 - protein, 11 aa, Artificial
  IGFBP-2 heparin binding domain-containing peptide sequence
RRHLGVNEPKR

SEQ ID NO: 1390 - protein, 11 aa, Artificial
  IGFBP-2 heparin binding domain-containing peptide sequence
HRHLGVNEPKR

SEQ ID NO: 1391 - protein, 11 aa, Artificial
  IGFBP-2 heparin binding domain-containing peptide sequence
KHKLGVNEPKR

SEQ ID NO: 1392 - protein, 11 aa, Artificial
  IGFBP-2 heparin binding domain-containing peptide sequence
RHKLGVNEPKR

SEQ ID NO: 1393 - protein, 11 aa, Artificial
  IGFBP-2 heparin binding domain-containing peptide sequence
HHKLGVNEPKR

SEQ ID NO: 1394 - protein, 11 aa, Artificial
  IGFBP-2 heparin binding domain-containing peptide sequence
KKKLGVNEPKR

SEQ ID NO: 1395 - protein, 11 aa, Artificial
  IGFBP-2 heparin binding domain-containing peptide sequence
RKKLGVNEPKR

SEQ ID NO: 1396 - protein, 11 aa, Artificial
  IGFBP-2 heparin binding domain-containing peptide sequence
HKKLGVNEPKR

SEQ ID NO: 1397 - protein, 11 aa, Artificial
  IGFBP-2 heparin binding domain-containing peptide sequence
KRKLGVNEPKR

SEQ ID NO: 1398 - protein, 11 aa, Artificial
  IGFBP-2 heparin binding domain-containing peptide sequence
RRKLGVNEPKR

SEQ ID NO: 1399 - protein, 11 aa, Artificial
  IGFBP-2 heparin binding domain-containing peptide sequence
HRKLGVNEPKR

SEQ ID NO: 1400 - protein, 11 aa, Artificial
  IGFBP-2 heparin binding domain-containing peptide sequence
KHRLGVNEPKR

SEQ ID NO: 1401 - protein, 11 aa, Artificial
  IGFBP-2 heparin binding domain-containing peptide sequence
RHRLGVNEPKR

SEQ ID NO: 1402 - protein, 11 aa, Artificial
  IGFBP-2 heparin binding domain-containing peptide sequence
HHRLGVNEPKR

SEQ ID NO: 1403 - protein, 11 aa, Artificial
  IGFBP-2 heparin binding domain-containing peptide sequence
KKRLGVNEPKR

SEQ ID NO: 1404 - protein, 11 aa, Artificial
  IGFBP-2 heparin binding domain-containing peptide sequence
RKRLGVNEPKR

SEQ ID NO: 1405 - protein, 11 aa, Artificial
  IGFBP-2 heparin binding domain-containing peptide sequence
HKRLGVNEPKR

SEQ ID NO: 1406 - protein, 11 aa, Artificial
  IGFBP-2 heparin binding domain-containing peptide sequence
KRRLGVNEPKR

SEQ ID NO: 1407 - protein, 11 aa, Artificial
  IGFBP-2 heparin binding domain-containing peptide sequence
RRRLGVNEPKR

SEQ ID NO: 1408 - protein, 11 aa, Artificial
  IGFBP-2 heparin binding domain-containing peptide sequence
HRRLGVNEPKR

SEQ ID NO: 1409 - protein, 11 aa, Artificial
  IGFBP-2 heparin binding domain-containing peptide sequence
KHHIGVNEPKR

SEQ ID NO: 1410 - protein, 11 aa, Artificial
  IGFBP-2 heparin binding domain-containing peptide sequence
RHHIGVNEPKR

SEQ ID NO: 1411 - protein, 11 aa, Artificial
  IGFBP-2 heparin binding domain-containing peptide sequence
HHHIGVNEPKR

SEQ ID NO: 1412 - protein, 11 aa, Artificial
  IGFBP-2 heparin binding domain-containing peptide sequence
KKHIGVNEPKR

SEQ ID NO: 1413 - protein, 11 aa, Artificial
  IGFBP-2 heparin binding domain-containing peptide sequence
RKHIGVNEPKR

SEQ ID NO: 1414 - protein, 11 aa, Artificial
  IGFBP-2 heparin binding domain-containing peptide sequence
HKHIGVNEPKR

SEQ ID NO: 1415 - protein, 11 aa, Artificial
  IGFBP-2 heparin binding domain-containing peptide sequence
KRHIGVNEPKR

SEQ ID NO: 1416 - protein, 11 aa, Artificial
  IGFBP-2 heparin binding domain-containing peptide sequence
RRHIGVNEPKR

SEQ ID NO: 1417 - protein, 11 aa, Artificial
  IGFBP-2 heparin binding domain-containing peptide sequence
HRHIGVNEPKR

SEQ ID NO: 1418 - protein, 11 aa, Artificial
  IGFBP-2 heparin binding domain-containing peptide sequence
KHKIGVNEPKR

SEQ ID NO: 1419 - protein, 11 aa, Artificial
  IGFBP-2 heparin binding domain-containing peptide sequence
RHKIGVNEPKR

SEQ ID NO: 1420 - protein, 11 aa, Artificial
  IGFBP-2 heparin binding domain-containing peptide sequence
HHKIGVNEPKR

SEQ ID NO: 1421 - protein, 11 aa, Artificial
  IGFBP-2 heparin binding domain-containing peptide sequence
KKKIGVNEPKR

SEQ ID NO: 1422 - protein, 11 aa, Artificial
  IGFBP-2 heparin binding domain-containing peptide sequence
RKKIGVNEPKR

SEQ ID NO: 1423 - protein, 11 aa, Artificial
  IGFBP-2 heparin binding domain-containing peptide sequence
HKKIGVNEPKR

SEQ ID NO: 1424 - protein, 11 aa, Artificial
  IGFBP-2 heparin binding domain-containing peptide sequence
KRKIGVNEPKR

SEQ ID NO: 1425 - protein, 11 aa, Artificial
  IGFBP-2 heparin binding domain-containing peptide sequence
RRKIGVNEPKR

SEQ ID NO: 1426 - protein, 11 aa, Artificial
  IGFBP-2 heparin binding domain-containing peptide sequence
HRKIGVNEPKR

SEQ ID NO: 1427 - protein, 11 aa, Artificial
  IGFBP-2 heparin binding domain-containing peptide sequence
KHRIGVNEPKR

SEQ ID NO: 1428 - protein, 11 aa, Artificial
  IGFBP-2 heparin binding domain-containing peptide sequence
RHRIGVNEPKR

SEQ ID NO: 1429 - protein, 11 aa, Artificial
  IGFBP-2 heparin binding domain-containing peptide sequence
HHRIGVNEPKR

SEQ ID NO: 1430 - protein, 11 aa, Artificial
  IGFBP-2 heparin binding domain-containing peptide sequence
KKRIGVNEPKR

SEQ ID NO: 1431 - protein, 11 aa, Artificial
  IGFBP-2 heparin binding domain-containing peptide sequence
RKRIGVNEPKR

SEQ ID NO: 1432 - protein, 11 aa, Artificial
  IGFBP-2 heparin binding domain-containing peptide sequence
HKRIGVNEPKR

SEQ ID NO: 1433 - protein, 11 aa, Artificial
  IGFBP-2 heparin binding domain-containing peptide sequence
KRRIGVNEPKR

SEQ ID NO: 1434 - protein, 11 aa, Artificial
  IGFBP-2 heparin binding domain-containing peptide sequence
RRRIGVNEPKR

SEQ ID NO: 1435 - protein, 11 aa, Artificial
  IGFBP-2 heparin binding domain-containing peptide sequence
HRRIGVNEPKR

SEQ ID NO: 1436 - protein, 11 aa, Artificial
  IGFBP-2 heparin binding domain-containing peptide sequence
KHHVGVNEPKR

SEQ ID NO: 1437 - protein, 11 aa, Artificial
  IGFBP-2 heparin binding domain-containing peptide sequence
RHHVGVNEPKR

SEQ ID NO: 1438 - protein, 11 aa, Artificial
  IGFBP-2 heparin binding domain-containing peptide sequence
HHHVGVNEPKR

SEQ ID NO: 1439 - protein, 11 aa, Artificial
  IGFBP-2 heparin binding domain-containing peptide sequence
KKHVGVNEPKR

SEQ ID NO: 1440 - protein, 11 aa, Artificial
  IGFBP-2 heparin binding domain-containing peptide sequence
RKHVGVNEPKR

SEQ ID NO: 1441 - protein, 11 aa, Artificial
  IGFBP-2 heparin binding domain-containing peptide sequence
HKHVGVNEPKR

SEQ ID NO: 1442 - protein, 11 aa, Artificial
  IGFBP-2 heparin binding domain-containing peptide sequence
KRHVGVNEPKR

SEQ ID NO: 1443 - protein, 11 aa, Artificial
  IGFBP-2 heparin binding domain-containing peptide sequence
RRHVGVNEPKR

SEQ ID NO: 1444 - protein, 11 aa, Artificial
  IGFBP-2 heparin binding domain-containing peptide sequence
HRHVGVNEPKR

SEQ ID NO: 1445 - protein, 11 aa, Artificial
  IGFBP-2 heparin binding domain-containing peptide sequence
KHKVGVNEPKR

SEQ ID NO: 1446 - protein, 11 aa, Artificial
  IGFBP-2 heparin binding domain-containing peptide sequence
RHKVGVNEPKR

SEQ ID NO: 1447 - protein, 11 aa, Artificial
  IGFBP-2 heparin binding domain-containing peptide sequence
HHKVGVNEPKR

SEQ ID NO: 1448 - protein, 11 aa, Artificial
  IGFBP-2 heparin binding domain-containing peptide sequence
KKKVGVNEPKR

SEQ ID NO: 1449 - protein, 11 aa, Artificial
  IGFBP-2 heparin binding domain-containing peptide sequence
RKKVGVNEPKR

SEQ ID NO: 1450 - protein, 11 aa, Artificial
  IGFBP-2 heparin binding domain-containing peptide sequence
HKKVGVNEPKR

SEQ ID NO: 1451 - protein, 11 aa, Artificial
  IGFBP-2 heparin binding domain-containing peptide sequence
KRKVGVNEPKR

SEQ ID NO: 1452 - protein, 11 aa, Artificial
  IGFBP-2 heparin binding domain-containing peptide sequence
RRKVGVNEPKR

SEQ ID NO: 1453 - protein, 11 aa, Artificial
  IGFBP-2 heparin binding domain-containing peptide sequence
HRKVGVNEPKR

SEQ ID NO: 1454 - protein, 11 aa, Artificial
  IGFBP-2 heparin binding domain-containing peptide sequence
KHRVGVNEPKR

SEQ ID NO: 1455 - protein, 11 aa, Artificial
  IGFBP-2 heparin binding domain-containing peptide sequence
RHRVGVNEPKR

SEQ ID NO: 1456 - protein, 11 aa, Artificial
  IGFBP-2 heparin binding domain-containing peptide sequence
HHRVGVNEPKR

SEQ ID NO: 1457 - protein, 11 aa, Artificial
  IGFBP-2 heparin binding domain-containing peptide sequence
KKRVGVNEPKR

SEQ ID NO: 1458 - protein, 11 aa, Artificial
  IGFBP-2 heparin binding domain-containing peptide sequence
RKRVGVNEPKR

SEQ ID NO: 1459 - protein, 11 aa, Artificial
  IGFBP-2 heparin binding domain-containing peptide sequence
HKRVGVNEPKR

SEQ ID NO: 1460 - protein, 11 aa, Artificial
  IGFBP-2 heparin binding domain-containing peptide sequence
KRRVGVNEPKR

SEQ ID NO: 1461 - protein, 11 aa, Artificial
  IGFBP-2 heparin binding domain-containing peptide sequence
RRRVGVNEPKR

SEQ ID NO: 1462 - protein, 11 aa, Artificial
  IGFBP-2 heparin binding domain-containing peptide sequence
HRRVGVNEPKR

SEQ ID NO: 1463 - protein, 11 aa, Artificial
  IGFBP-2 heparin binding domain-containing peptide sequence
KHHLGLENPKR

SEQ ID NO: 1464 - protein, 11 aa, Artificial
  IGFBP-2 heparin binding domain-containing peptide sequence
RHHLGLENPKR

SEQ ID NO: 1465 - protein, 11 aa, Artificial
  IGFBP-2 heparin binding domain-containing peptide sequence
HHHLGLENPKR

SEQ ID NO: 1466 - protein, 11 aa, Artificial
  IGFBP-2 heparin binding domain-containing peptide sequence
KKHLGLENPKR

SEQ ID NO: 1467 - protein, 11 aa, Artificial
  IGFBP-2 heparin binding domain-containing peptide sequence
RKHLGLENPKR

SEQ ID NO: 1468 - protein, 11 aa, Artificial
  IGFBP-2 heparin binding domain-containing peptide sequence
HKHLGLENPKR

SEQ ID NO: 1469 - protein, 11 aa, Artificial
  IGFBP-2 heparin binding domain-containing peptide sequence
KRHLGLENPKR

SEQ ID NO: 1470 - protein, 11 aa, Artificial
  IGFBP-2 heparin binding domain-containing peptide sequence
RRHLGLENPKR

SEQ ID NO: 1471 - protein, 11 aa, Artificial
  IGFBP-2 heparin binding domain-containing peptide sequence
HRHLGLENPKR

SEQ ID NO: 1472 - protein, 11 aa, Artificial
  IGFBP-2 heparin binding domain-containing peptide sequence
KHKLGLENPKR

SEQ ID NO: 1473 - protein, 11 aa, Artificial
  IGFBP-2 heparin binding domain-containing peptide sequence
RHKLGLENPKR

SEQ ID NO: 1474 - protein, 11 aa, Artificial
  IGFBP-2 heparin binding domain-containing peptide sequence
HHKLGLENPKR

SEQ ID NO: 1475 - protein, 11 aa, Artificial
  IGFBP-2 heparin binding domain-containing peptide sequence
KKKLGLENPKR

SEQ ID NO: 1476 - protein, 11 aa, Artificial
  IGFBP-2 heparin binding domain-containing peptide sequence
RKKLGLENPKR

SEQ ID NO: 1477 - protein, 11 aa, Artificial
  IGFBP-2 heparin binding domain-containing peptide sequence
HKKLGLENPKR

SEQ ID NO: 1478 - protein, 11 aa, Artificial
  IGFBP-2 heparin binding domain-containing peptide sequence
KRKLGLENPKR

SEQ ID NO: 1479 - protein, 11 aa, Artificial
  IGFBP-2 heparin binding domain-containing peptide sequence
RRKLGLENPKR

SEQ ID NO: 1480 - protein, 11 aa, Artificial
  IGFBP-2 heparin binding domain-containing peptide sequence
HRKLGLENPKR

SEQ ID NO: 1481 - protein, 11 aa, Artificial
  IGFBP-2 heparin binding domain-containing peptide sequence
KHRLGLENPKR

SEQ ID NO: 1482 - protein, 11 aa, Artificial
  IGFBP-2 heparin binding domain-containing peptide sequence
RHRLGLENPKR

SEQ ID NO: 1483 - protein, 11 aa, Artificial
  IGFBP-2 heparin binding domain-containing peptide sequence
HHRLGLENPKR

SEQ ID NO: 1484 - protein, 11 aa, Artificial
  IGFBP-2 heparin binding domain-containing peptide sequence
KKRLGLENPKR

SEQ ID NO: 1485 - protein, 11 aa, Artificial
  IGFBP-2 heparin binding domain-containing peptide sequence
RKRLGLENPKR

SEQ ID NO: 1486 - protein, 11 aa, Artificial
  IGFBP-2 heparin binding domain-containing peptide sequence
HKRLGLENPKR

SEQ ID NO: 1487 - protein, 11 aa, Artificial
  IGFBP-2 heparin binding domain-containing peptide sequence
KRRLGLENPKR

SEQ ID NO: 1488 - protein, 11 aa, Artificial
  IGFBP-2 heparin binding domain-containing peptide sequence
RRRLGLENPKR

SEQ ID NO: 1489 - protein, 11 aa, Artificial
  IGFBP-2 heparin binding domain-containing peptide sequence
HRRLGLENPKR

SEQ ID NO: 1490 - protein, 11 aa, Artificial
  IGFBP-2 heparin binding domain-containing peptide sequence
KHHIGLENPKR

SEQ ID NO: 1491 - protein, 11 aa, Artificial
  IGFBP-2 heparin binding domain-containing peptide sequence
RHHIGLENPKR

SEQ ID NO: 1492 - protein, 11 aa, Artificial
  IGFBP-2 heparin binding domain-containing peptide sequence
HHHIGLENPKR

SEQ ID NO: 1493 - protein, 11 aa, Artificial
  IGFBP-2 heparin binding domain-containing peptide sequence
KKHIGLENPKR

SEQ ID NO: 1494 - protein, 11 aa, Artificial
  IGFBP-2 heparin binding domain-containing peptide sequence
RKHIGLENPKR

SEQ ID NO: 1495 - protein, 11 aa, Artificial
  IGFBP-2 heparin binding domain-containing peptide sequence
HKHIGLENPKR

SEQ ID NO: 1496 - protein, 11 aa, Artificial
  IGFBP-2 heparin binding domain-containing peptide sequence
KRHIGLENPKR

SEQ ID NO: 1497 - protein, 11 aa, Artificial
  IGFBP-2 heparin binding domain-containing peptide sequence
RRHIGLENPKR

SEQ ID NO: 1498 - protein, 11 aa, Artificial
  IGFBP-2 heparin binding domain-containing peptide sequence
HRHIGLENPKR

SEQ ID NO: 1499 - protein, 11 aa, Artificial
  IGFBP-2 heparin binding domain-containing peptide sequence
KHKIGLENPKR

SEQ ID NO: 1500 - protein, 11 aa, Artificial
  IGFBP-2 heparin binding domain-containing peptide sequence
RHKIGLENPKR

SEQ ID NO: 1501 - protein, 11 aa, Artificial
  IGFBP-2 heparin binding domain-containing peptide sequence
HHKIGLENPKR

SEQ ID NO: 1502 - protein, 11 aa, Artificial
  IGFBP-2 heparin binding domain-containing peptide sequence
KKKIGLENPKR

SEQ ID NO: 1503 - protein, 11 aa, Artificial
  IGFBP-2 heparin binding domain-containing peptide sequence
RKKIGLENPKR

SEQ ID NO: 1504 - protein, 11 aa, Artificial
  IGFBP-2 heparin binding domain-containing peptide sequence
HKKIGLENPKR

SEQ ID NO: 1505 - protein, 11 aa, Artificial
  IGFBP-2 heparin binding domain-containing peptide sequence
KRKIGLENPKR

SEQ ID NO: 1506 - protein, 11 aa, Artificial
  IGFBP-2 heparin binding domain-containing peptide sequence
RRKIGLENPKR

SEQ ID NO: 1507 - protein, 11 aa, Artificial
  IGFBP-2 heparin binding domain-containing peptide sequence
HRKIGLENPKR

SEQ ID NO: 1508 - protein, 11 aa, Artificial
  IGFBP-2 heparin binding domain-containing peptide sequence
KHRIGLENPKR

SEQ ID NO: 1509 - protein, 11 aa, Artificial
  IGFBP-2 heparin binding domain-containing peptide sequence
RHRIGLENPKR

SEQ ID NO: 1510 - protein, 11 aa, Artificial
  IGFBP-2 heparin binding domain-containing peptide sequence
HHRIGLENPKR

SEQ ID NO: 1511 - protein, 11 aa, Artificial
  IGFBP-2 heparin binding domain-containing peptide sequence
KKRIGLENPKR

SEQ ID NO: 1512 - protein, 11 aa, Artificial
  IGFBP-2 heparin binding domain-containing peptide sequence
RKRIGLENPKR

SEQ ID NO: 1513 - protein, 11 aa, Artificial
  IGFBP-2 heparin binding domain-containing peptide sequence
HKRIGLENPKR

SEQ ID NO: 1514 - protein, 11 aa, Artificial
  IGFBP-2 heparin binding domain-containing peptide sequence
KRRIGLENPKR

SEQ ID NO: 1515 - protein, 11 aa, Artificial
  IGFBP-2 heparin binding domain-containing peptide sequence
RRRIGLENPKR

SEQ ID NO: 1516 - protein, 11 aa, Artificial
  IGFBP-2 heparin binding domain-containing peptide sequence
HRRIGLENPKR

SEQ ID NO: 1517 - protein, 11 aa, Artificial
  IGFBP-2 heparin binding domain-containing peptide sequence
KHHVGLENPKR

SEQ ID NO: 1518 - protein, 11 aa, Artificial
  IGFBP-2 heparin binding domain-containing peptide sequence
RHHVGLENPKR

SEQ ID NO: 1519 - protein, 11 aa, Artificial
  IGFBP-2 heparin binding domain-containing peptide sequence
HHHVGLENPKR

SEQ ID NO: 1520 - protein, 11 aa, Artificial
  IGFBP-2 heparin binding domain-containing peptide sequence
KKHVGLENPKR

SEQ ID NO: 1521 - protein, 11 aa, Artificial
  IGFBP-2 heparin binding domain-containing peptide sequence
RKHVGLENPKR

SEQ ID NO: 1522 - protein, 11 aa, Artificial
  IGFBP-2 heparin binding domain-containing peptide sequence
HKHVGLENPKR

SEQ ID NO: 1523 - protein, 11 aa, Artificial
  IGFBP-2 heparin binding domain-containing peptide sequence
KRHVGLENPKR

SEQ ID NO: 1524 - protein, 11 aa, Artificial
  IGFBP-2 heparin binding domain-containing peptide sequence
RRHVGLENPKR

SEQ ID NO: 1525 - protein, 11 aa, Artificial
  IGFBP-2 heparin binding domain-containing peptide sequence
HRHVGLENPKR

SEQ ID NO: 1526 - protein, 11 aa, Artificial
  IGFBP-2 heparin binding domain-containing peptide sequence
KHKVGLENPKR

SEQ ID NO: 1527 - protein, 11 aa, Artificial
  IGFBP-2 heparin binding domain-containing peptide sequence
RHKVGLENPKR

SEQ ID NO: 1528 - protein, 11 aa, Artificial
  IGFBP-2 heparin binding domain-containing peptide sequence
HHKVGLENPKR

SEQ ID NO: 1529 - protein, 11 aa, Artificial
  IGFBP-2 heparin binding domain-containing peptide sequence
KKKVGLENPKR

SEQ ID NO: 1530 - protein, 11 aa, Artificial
  IGFBP-2 heparin binding domain-containing peptide sequence
RKKVGLENPKR

SEQ ID NO: 1531 - protein, 11 aa, Artificial
  IGFBP-2 heparin binding domain-containing peptide sequence
HKKVGLENPKR

SEQ ID NO: 1532 - protein, 11 aa, Artificial
  IGFBP-2 heparin binding domain-containing peptide sequence
KRKVGLENPKR

SEQ ID NO: 1533 - protein, 11 aa, Artificial
  IGFBP-2 heparin binding domain-containing peptide sequence
RRKVGLENPKR

SEQ ID NO: 1534 - protein, 11 aa, Artificial
  IGFBP-2 heparin binding domain-containing peptide sequence
HRKVGLENPKR

SEQ ID NO: 1535 - protein, 11 aa, Artificial
  IGFBP-2 heparin binding domain-containing peptide sequence
KHRVGLENPKR

SEQ ID NO: 1536 - protein, 11 aa, Artificial
  IGFBP-2 heparin binding domain-containing peptide sequence
RHRVGLENPKR

SEQ ID NO: 1537 - protein, 11 aa, Artificial
  IGFBP-2 heparin binding domain-containing peptide sequence
HHRVGLENPKR

SEQ ID NO: 1538 - protein, 11 aa, Artificial
  IGFBP-2 heparin binding domain-containing peptide sequence
KKRVGLENPKR

SEQ ID NO: 1539 - protein, 11 aa, Artificial
  IGFBP-2 heparin binding domain-containing peptide sequence
RKRVGLENPKR

SEQ ID NO: 1540 - protein, 11 aa, Artificial
  IGFBP-2 heparin binding domain-containing peptide sequence
HKRVGLENPKR

SEQ ID NO: 1541 - protein, 11 aa, Artificial
  IGFBP-2 heparin binding domain-containing peptide sequence
KRRVGLENPKR

SEQ ID NO: 1542 - protein, 11 aa, Artificial
  IGFBP-2 heparin binding domain-containing peptide sequence
RRRVGLENPKR

SEQ ID NO: 1543 - protein, 11 aa, Artificial
  IGFBP-2 heparin binding domain-containing peptide sequence
HRRVGLENPKR

SEQ ID NO: 1544 - protein, 11 aa, Artificial
  IGFBP-2 heparin binding domain-containing peptide sequence
KHHLGIENPKR

SEQ ID NO: 1545 - protein, 11 aa, Artificial
  IGFBP-2 heparin binding domain-containing peptide sequence
RHHLGIENPKR

SEQ ID NO: 1546 - protein, 11 aa, Artificial
  IGFBP-2 heparin binding domain-containing peptide sequence
HHHLGIENPKR

SEQ ID NO: 1547 - protein, 11 aa, Artificial
  IGFBP-2 heparin binding domain-containing peptide sequence
KKHLGIENPKR

SEQ ID NO: 1548 - protein, 11 aa, Artificial
  IGFBP-2 heparin binding domain-containing peptide sequence
RKHLGIENPKR

SEQ ID NO: 1549 - protein, 11 aa, Artificial
  IGFBP-2 heparin binding domain-containing peptide sequence
HKHLGIENPKR

SEQ ID NO: 1550 - protein, 11 aa, Artificial
  IGFBP-2 heparin binding domain-containing peptide sequence
KRHLGIENPKR

SEQ ID NO: 1551 - protein, 11 aa, Artificial
  IGFBP-2 heparin binding domain-containing peptide sequence
RRHLGIENPKR

SEQ ID NO: 1552 - protein, 11 aa, Artificial
  IGFBP-2 heparin binding domain-containing peptide sequence
HRHLGIENPKR

SEQ ID NO: 1553 - protein, 11 aa, Artificial
  IGFBP-2 heparin binding domain-containing peptide sequence
KHKLGIENPKR

SEQ ID NO: 1554 - protein, 11 aa, Artificial
  IGFBP-2 heparin binding domain-containing peptide sequence
RHKLGIENPKR

SEQ ID NO: 1555 - protein, 11 aa, Artificial
  IGFBP-2 heparin binding domain-containing peptide sequence
HHKLGIENPKR

SEQ ID NO: 1556 - protein, 11 aa, Artificial
  IGFBP-2 heparin binding domain-containing peptide sequence
KKKLGIENPKR

SEQ ID NO: 1557 - protein, 11 aa, Artificial
  IGFBP-2 heparin binding domain-containing peptide sequence
RKKLGIENPKR

SEQ ID NO: 1558 - protein, 11 aa, Artificial
  IGFBP-2 heparin binding domain-containing peptide sequence
HKKLGIENPKR

SEQ ID NO: 1559 - protein, 11 aa, Artificial
  IGFBP-2 heparin binding domain-containing peptide sequence
KRKLGIENPKR

SEQ ID NO: 1560 - protein, 11 aa, Artificial
  IGFBP-2 heparin binding domain-containing peptide sequence
RRKLGIENPKR

SEQ ID NO: 1561 - protein, 11 aa, Artificial
  IGFBP-2 heparin binding domain-containing peptide sequence
HRKLGIENPKR

SEQ ID NO: 1562 - protein, 11 aa, Artificial
  IGFBP-2 heparin binding domain-containing peptide sequence
KHRLGIENPKR

SEQ ID NO: 1563 - protein, 11 aa, Artificial
  IGFBP-2 heparin binding domain-containing peptide sequence
RHRLGIENPKR

SEQ ID NO: 1564 - protein, 11 aa, Artificial
  IGFBP-2 heparin binding domain-containing peptide sequence
HHRLGIENPKR

SEQ ID NO: 1565 - protein, 11 aa, Artificial
  IGFBP-2 heparin binding domain-containing peptide sequence
KKRLGIENPKR

SEQ ID NO: 1566 - protein, 11 aa, Artificial
  IGFBP-2 heparin binding domain-containing peptide sequence
RKRLGIENPKR

SEQ ID NO: 1567 - protein, 11 aa, Artificial
  IGFBP-2 heparin binding domain-containing peptide sequence
HKRLGIENPKR

SEQ ID NO: 1568 - protein, 11 aa, Artificial
  IGFBP-2 heparin binding domain-containing peptide sequence
KRRLGIENPKR

SEQ ID NO: 1569 - protein, 11 aa, Artificial
  IGFBP-2 heparin binding domain-containing peptide sequence
RRRLGIENPKR

SEQ ID NO: 1570 - protein, 11 aa, Artificial
  IGFBP-2 heparin binding domain-containing peptide sequence
HRRLGIENPKR

SEQ ID NO: 1571 - protein, 11 aa, Artificial
  IGFBP-2 heparin binding domain-containing peptide sequence
KHHIGIENPKR

SEQ ID NO: 1572 - protein, 11 aa, Artificial
  IGFBP-2 heparin binding domain-containing peptide sequence
RHHIGIENPKR

SEQ ID NO: 1573 - protein, 11 aa, Artificial
  IGFBP-2 heparin binding domain-containing peptide sequence
HHHIGIENPKR

SEQ ID NO: 1574 - protein, 11 aa, Artificial
  IGFBP-2 heparin binding domain-containing peptide sequence
KKHIGIENPKR

SEQ ID NO: 1575 - protein, 11 aa, Artificial
  IGFBP-2 heparin binding domain-containing peptide sequence
RKHIGIENPKR

SEQ ID NO: 1576 - protein, 11 aa, Artificial
  IGFBP-2 heparin binding domain-containing peptide sequence
HKHIGIENPKR

SEQ ID NO: 1577 - protein, 11 aa, Artificial
  IGFBP-2 heparin binding domain-containing peptide sequence
KRHIGIENPKR

SEQ ID NO: 1578 - protein, 11 aa, Artificial
  IGFBP-2 heparin binding domain-containing peptide sequence
RRHIGIENPKR

SEQ ID NO: 1579 - protein, 11 aa, Artificial
  IGFBP-2 heparin binding domain-containing peptide sequence
HRHIGIENPKR

SEQ ID NO: 1580 - protein, 11 aa, Artificial
  IGFBP-2 heparin binding domain-containing peptide sequence
KHKIGIENPKR

SEQ ID NO: 1581 - protein, 11 aa, Artificial
  IGFBP-2 heparin binding domain-containing peptide sequence
RHKIGIENPKR

SEQ ID NO: 1582 - protein, 11 aa, Artificial
  IGFBP-2 heparin binding domain-containing peptide sequence
HHKIGIENPKR

SEQ ID NO: 1583 - protein, 11 aa, Artificial
  IGFBP-2 heparin binding domain-containing peptide sequence
KKKIGIENPKR

SEQ ID NO: 1584 - protein, 11 aa, Artificial
  IGFBP-2 heparin binding domain-containing peptide sequence
RKKIGIENPKR

SEQ ID NO: 1585 - protein, 11 aa, Artificial
  IGFBP-2 heparin binding domain-containing peptide sequence
HKKIGIENPKR

SEQ ID NO: 1586 - protein, 11 aa, Artificial
  IGFBP-2 heparin binding domain-containing peptide sequence
KRKIGIENPKR

SEQ ID NO: 1587 - protein, 11 aa, Artificial
  IGFBP-2 heparin binding domain-containing peptide sequence
RRKIGIENPKR

SEQ ID NO: 1588 - protein, 11 aa, Artificial
  IGFBP-2 heparin binding domain-containing peptide sequence
HRKIGIENPKR

SEQ ID NO: 1589 - protein, 11 aa, Artificial
  IGFBP-2 heparin binding domain-containing peptide sequence
KHRIGIENPKR

SEQ ID NO: 1590 - protein, 11 aa, Artificial
  IGFBP-2 heparin binding domain-containing peptide sequence
RHRIGIENPKR

SEQ ID NO: 1591 - protein, 11 aa, Artificial
  IGFBP-2 heparin binding domain-containing peptide sequence
HHRIGIENPKR

SEQ ID NO: 1592 - protein, 11 aa, Artificial
  IGFBP-2 heparin binding domain-containing peptide sequence
KKRIGIENPKR

SEQ ID NO: 1593 - protein, 11 aa, Artificial
  IGFBP-2 heparin binding domain-containing peptide sequence
RKRIGIENPKR

SEQ ID NO: 1594 - protein, 11 aa, Artificial
  IGFBP-2 heparin binding domain-containing peptide sequence
HKRIGIENPKR

SEQ ID NO: 1595 - protein, 11 aa, Artificial
  IGFBP-2 heparin binding domain-containing peptide sequence
KRRIGIENPKR

SEQ ID NO: 1596 - protein, 11 aa, Artificial
  IGFBP-2 heparin binding domain-containing peptide sequence
RRRIGIENPKR

SEQ ID NO: 1597 - protein, 11 aa, Artificial
  IGFBP-2 heparin binding domain-containing peptide sequence
HRRIGIENPKR

SEQ ID NO: 1598 - protein, 11 aa, Artificial
  IGFBP-2 heparin binding domain-containing peptide sequence
KHHVGIENPKR

SEQ ID NO: 1599 - protein, 11 aa, Artificial
  IGFBP-2 heparin binding domain-containing peptide sequence
RHHVGIENPKR

SEQ ID NO: 1600 - protein, 11 aa, Artificial
  IGFBP-2 heparin binding domain-containing peptide sequence
HHHVGIENPKR

SEQ ID NO: 1601 - protein, 11 aa, Artificial
  IGFBP-2 heparin binding domain-containing peptide sequence
KKHVGIENPKR

SEQ ID NO: 1602 - protein, 11 aa, Artificial
  IGFBP-2 heparin binding domain-containing peptide sequence
RKHVGIENPKR

SEQ ID NO: 1603 - protein, 11 aa, Artificial
  IGFBP-2 heparin binding domain-containing peptide sequence
HKHVGIENPKR

SEQ ID NO: 1604 - protein, 11 aa, Artificial
  IGFBP-2 heparin binding domain-containing peptide sequence
KRHVGIENPKR

SEQ ID NO: 1605 - protein, 11 aa, Artificial
  IGFBP-2 heparin binding domain-containing peptide sequence
RRHVGIENPKR

SEQ ID NO: 1606 - protein, 11 aa, Artificial
  IGFBP-2 heparin binding domain-containing peptide sequence
HRHVGIENPKR

SEQ ID NO: 1607 - protein, 11 aa, Artificial
  IGFBP-2 heparin binding domain-containing peptide sequence
KHKVGIENPKR

SEQ ID NO: 1608 - protein, 11 aa, Artificial
  IGFBP-2 heparin binding domain-containing peptide sequence
RHKVGIENPKR

SEQ ID NO: 1609 - protein, 11 aa, Artificial
  IGFBP-2 heparin binding domain-containing peptide sequence
HHKVGIENPKR

SEQ ID NO: 1610 - protein, 11 aa, Artificial
  IGFBP-2 heparin binding domain-containing peptide sequence
KKKVGIENPKR

SEQ ID NO: 1611 - protein, 11 aa, Artificial
  IGFBP-2 heparin binding domain-containing peptide sequence
RKKVGIENPKR

SEQ ID NO: 1612 - protein, 11 aa, Artificial
  IGFBP-2 heparin binding domain-containing peptide sequence
HKKVGIENPKR

SEQ ID NO: 1613 - protein, 11 aa, Artificial
  IGFBP-2 heparin binding domain-containing peptide sequence
KRKVGIENPKR

SEQ ID NO: 1614 - protein, 11 aa, Artificial
  IGFBP-2 heparin binding domain-containing peptide sequence
RRKVGIENPKR

SEQ ID NO: 1615 - protein, 11 aa, Artificial
  IGFBP-2 heparin binding domain-containing peptide sequence
HRKVGIENPKR

SEQ ID NO: 1616 - protein, 11 aa, Artificial
  IGFBP-2 heparin binding domain-containing peptide sequence
KHRVGIENPKR

SEQ ID NO: 1617 - protein, 11 aa, Artificial
  IGFBP-2 heparin binding domain-containing peptide sequence
RHRVGIENPKR

SEQ ID NO: 1618 - protein, 11 aa, Artificial
  IGFBP-2 heparin binding domain-containing peptide sequence
HHRVGIENPKR

SEQ ID NO: 1619 - protein, 11 aa, Artificial
  IGFBP-2 heparin binding domain-containing peptide sequence
KKRVGIENPKR

SEQ ID NO: 1620 - protein, 11 aa, Artificial
  IGFBP-2 heparin binding domain-containing peptide sequence
RKRVGIENPKR

SEQ ID NO: 1621 - protein, 11 aa, Artificial
  IGFBP-2 heparin binding domain-containing peptide sequence
HKRVGIENPKR

SEQ ID NO: 1622 - protein, 11 aa, Artificial
  IGFBP-2 heparin binding domain-containing peptide sequence
KRRVGIENPKR

SEQ ID NO: 1623 - protein, 11 aa, Artificial
  IGFBP-2 heparin binding domain-containing peptide sequence
RRRVGIENPKR

SEQ ID NO: 1624 - protein, 11 aa, Artificial
  IGFBP-2 heparin binding domain-containing peptide sequence
HRRVGIENPKR

SEQ ID NO: 1625 - protein, 11 aa, Artificial
  IGFBP-2 heparin binding domain-containing peptide sequence
KHHLGVENPKR

SEQ ID NO: 1626 - protein, 11 aa, Artificial
  IGFBP-2 heparin binding domain-containing peptide sequence
RHHLGVENPKR

SEQ ID NO: 1627 - protein, 11 aa, Artificial
  IGFBP-2 heparin binding domain-containing peptide sequence
HHHLGVENPKR

SEQ ID NO: 1628 - protein, 11 aa, Artificial
  IGFBP-2 heparin binding domain-containing peptide sequence
KKHLGVENPKR

SEQ ID NO: 1629 - protein, 11 aa, Artificial
  IGFBP-2 heparin binding domain-containing peptide sequence
RKHLGVENPKR

SEQ ID NO: 1630 - protein, 11 aa, Artificial
  IGFBP-2 heparin binding domain-containing peptide sequence
HKHLGVENPKR

SEQ ID NO: 1631 - protein, 11 aa, Artificial
  IGFBP-2 heparin binding domain-containing peptide sequence
KRHLGVENPKR

SEQ ID NO: 1632 - protein, 11 aa, Artificial
  IGFBP-2 heparin binding domain-containing peptide sequence
RRHLGVENPKR

SEQ ID NO: 1633 - protein, 11 aa, Artificial
  IGFBP-2 heparin binding domain-containing peptide sequence
HRHLGVENPKR

SEQ ID NO: 1634 - protein, 11 aa, Artificial
  IGFBP-2 heparin binding domain-containing peptide sequence
KHKLGVENPKR

SEQ ID NO: 1635 - protein, 11 aa, Artificial
  IGFBP-2 heparin binding domain-containing peptide sequence
RHKLGVENPKR

SEQ ID NO: 1636 - protein, 11 aa, Artificial
  IGFBP-2 heparin binding domain-containing peptide sequence
HHKLGVENPKR

SEQ ID NO: 1637 - protein, 11 aa, Artificial
  IGFBP-2 heparin binding domain-containing peptide sequence
KKKLGVENPKR

SEQ ID NO: 1638 - protein, 11 aa, Artificial
  IGFBP-2 heparin binding domain-containing peptide sequence
RKKLGVENPKR

SEQ ID NO: 1639 - protein, 11 aa, Artificial
  IGFBP-2 heparin binding domain-containing peptide sequence
HKKLGVENPKR

SEQ ID NO: 1640 - protein, 11 aa, Artificial
  IGFBP-2 heparin binding domain-containing peptide sequence
KRKLGVENPKR

SEQ ID NO: 1641 - protein, 11 aa, Artificial
  IGFBP-2 heparin binding domain-containing peptide sequence
RRKLGVENPKR

SEQ ID NO: 1642 - protein, 11 aa, Artificial
  IGFBP-2 heparin binding domain-containing peptide sequence
HRKLGVENPKR

SEQ ID NO: 1643 - protein, 11 aa, Artificial
  IGFBP-2 heparin binding domain-containing peptide sequence
KHRLGVENPKR

SEQ ID NO: 1644 - protein, 11 aa, Artificial
  IGFBP-2 heparin binding domain-containing peptide sequence
RHRLGVENPKR

SEQ ID NO: 1645 - protein, 11 aa, Artificial
  IGFBP-2 heparin binding domain-containing peptide sequence
HHRLGVENPKR

SEQ ID NO: 1646 - protein, 11 aa, Artificial
  IGFBP-2 heparin binding domain-containing peptide sequence
KKRLGVENPKR

SEQ ID NO: 1647 - protein, 11 aa, Artificial
  IGFBP-2 heparin binding domain-containing peptide sequence
RKRLGVENPKR

SEQ ID NO: 1648 - protein, 11 aa, Artificial
  IGFBP-2 heparin binding domain-containing peptide sequence
HKRLGVENPKR

SEQ ID NO: 1649 - protein, 11 aa, Artificial
  IGFBP-2 heparin binding domain-containing peptide sequence
KRRLGVENPKR

SEQ ID NO: 1650 - protein, 11 aa, Artificial
  IGFBP-2 heparin binding domain-containing peptide sequence
RRRLGVENPKR

SEQ ID NO: 1651 - protein, 11 aa, Artificial
  IGFBP-2 heparin binding domain-containing peptide sequence
HRRLGVENPKR

SEQ ID NO: 1652 - protein, 11 aa, Artificial
  IGFBP-2 heparin binding domain-containing peptide sequence
KHHIGVENPKR

SEQ ID NO: 1653 - protein, 11 aa, Artificial
  IGFBP-2 heparin binding domain-containing peptide sequence
RHHIGVEEPKR

SEQ ID NO: 1654 - protein, 11 aa, Artificial
  IGFBP-2 heparin binding domain-containing peptide sequence
HHHIGVENPKR

SEQ ID NO: 1655 - protein, 11 aa, Artificial
  IGFBP-2 heparin binding domain-containing peptide sequence
KKHIGVENPKR

SEQ ID NO: 1656 - protein, 11 aa, Artificial
  IGFBP-2 heparin binding domain-containing peptide sequence
RKHIGVENPKR

SEQ ID NO: 1657 - protein, 11 aa, Artificial
  IGFBP-2 heparin binding domain-containing peptide sequence
HKHIGVENPKR

SEQ ID NO: 1658 - protein, 11 aa, Artificial
  IGFBP-2 heparin binding domain-containing peptide sequence
KRHIGVENPKR

SEQ ID NO: 1659 - protein, 11 aa, Artificial
  IGFBP-2 heparin binding domain-containing peptide sequence
RRHIGVENPKR

SEQ ID NO: 1660 - protein, 11 aa, Artificial
  IGFBP-2 heparin binding domain-containing peptide sequence
HRHIGVENPKR

SEQ ID NO: 1661 - protein, 11 aa, Artificial
  IGFBP-2 heparin binding domain-containing peptide sequence
KHKIGVENPKR

SEQ ID NO: 1662 - protein, 11 aa, Artificial
  IGFBP-2 heparin binding domain-containing peptide sequence
RHKIGVENPKR

SEQ ID NO: 1663 - protein, 11 aa, Artificial
  IGFBP-2 heparin binding domain-containing peptide sequence
HHKIGVENPKR

SEQ ID NO: 1664 - protein, 11 aa, Artificial
  IGFBP-2 heparin binding domain-containing peptide sequence
KKKIGVENPKR

SEQ ID NO: 1665 - protein, 11 aa, Artificial
  IGFBP-2 heparin binding domain-containing peptide sequence
RKKIGVENPKR

SEQ ID NO: 1666 - protein, 11 aa, Artificial
  IGFBP-2 heparin binding domain-containing peptide sequence
HKKIGVENPKR

SEQ ID NO: 1667 - protein, 11 aa, Artificial
  IGFBP-2 heparin binding domain-containing peptide sequence
KRKIGVENPKR

SEQ ID NO: 1668 - protein, 11 aa, Artificial
  IGFBP-2 heparin binding domain-containing peptide sequence
RRKIGVENPKR

SEQ ID NO: 1669 - protein, 11 aa, Artificial
  IGFBP-2 heparin binding domain-containing peptide sequence
HRKIGVENPKR

SEQ ID NO: 1670 - protein, 11 aa, Artificial
  IGFBP-2 heparin binding domain-containing peptide sequence
KHRIGVENPKR

SEQ ID NO: 1671 - protein, 11 aa, Artificial
  IGFBP-2 heparin binding domain-containing peptide sequence
RHRIGVENPKR

SEQ ID NO: 1672 - protein, 11 aa, Artificial
  IGFBP-2 heparin binding domain-containing peptide sequence
HHRIGVENPKR

SEQ ID NO: 1673 - protein, 11 aa, Artificial
  IGFBP-2 heparin binding domain-containing peptide sequence
KKRIGVENPKR

SEQ ID NO: 1674 - protein, 11 aa, Artificial
  IGFBP-2 heparin binding domain-containing peptide sequence
RKRIGVENPKR

SEQ ID NO: 1675 - protein, 11 aa, Artificial
  IGFBP-2 heparin binding domain-containing peptide sequence
HKRIGVENPKR

SEQ ID NO: 1676 - protein, 11 aa, Artificial
  IGFBP-2 heparin binding domain-containing peptide sequence
KRRIGVENPKR

SEQ ID NO: 1677 - protein, 11 aa, Artificial
  IGFBP-2 heparin binding domain-containing peptide sequence
RRRIGVENPKR

SEQ ID NO: 1678 - protein, 11 aa, Artificial
  IGFBP-2 heparin binding domain-containing peptide sequence
HRRIGVENPKR

SEQ ID NO: 1679 - protein, 11 aa, Artificial
  IGFBP-2 heparin binding domain-containing peptide sequence
KHHVGVENPKR

SEQ ID NO: 1680 - protein, 11 aa, Artificial
  IGFBP-2 heparin binding domain-containing peptide sequence
RHHVGVENPKR

SEQ ID NO: 1681 - protein, 11 aa, Artificial
  IGFBP-2 heparin binding domain-containing peptide sequence
HHHVGVENPKR

SEQ ID NO: 1682 - protein, 11 aa, Artificial
  IGFBP-2 heparin binding domain-containing peptide sequence
KKHVGVENPKR

SEQ ID NO: 1683 - protein, 11 aa, Artificial
  IGFBP-2 heparin binding domain-containing peptide sequence
RKHVGVENPKR

SEQ ID NO: 1684 - protein, 11 aa, Artificial
  IGFBP-2 heparin binding domain-containing peptide sequence
HKHVGVENPKR

SEQ ID NO: 1685 - protein, 11 aa, Artificial
  IGFBP-2 heparin binding domain-containing peptide sequence
KRHVGVENPKR

SEQ ID NO: 1686 - protein, 11 aa, Artificial
  IGFBP-2 heparin binding domain-containing peptide sequence
RRHVGVENPKR

SEQ ID NO: 1687 - protein, 11 aa, Artificial
  IGFBP-2 heparin binding domain-containing peptide sequence
HRHVGVENPKR

SEQ ID NO: 1688 - protein, 11 aa, Artificial
  IGFBP-2 heparin binding domain-containing peptide sequence
KHKVGVENPKR

SEQ ID NO: 1689 - protein, 11 aa, Artificial
  IGFBP-2 heparin binding domain-containing peptide sequence
RHKVGVENPKR

SEQ ID NO: 1690 - protein, 11 aa, Artificial
  IGFBP-2 heparin binding domain-containing peptide sequence
HHKVGVENPKR

SEQ ID NO: 1691 - protein, 11 aa, Artificial
  IGFBP-2 heparin binding domain-containing peptide sequence
KKKVGVENPKR

SEQ ID NO: 1692 - protein, 11 aa, Artificial
  IGFBP-2 heparin binding domain-containing peptide sequence
RKKVGVENPKR

SEQ ID NO: 1693 - protein, 11 aa, Artificial
  IGFBP-2 heparin binding domain-containing peptide sequence
HKKVGVENPKR

SEQ ID NO: 1694 - protein, 11 aa, Artificial
  IGFBP-2 heparin binding domain-containing peptide sequence
KRKVGVENPKR

SEQ ID NO: 1695 - protein, 11 aa, Artificial
  IGFBP-2 heparin binding domain-containing peptide sequence
RRKVGVEEPKR

SEQ ID NO: 1696 - protein, 11 aa, Artificial
  IGFBP-2 heparin binding domain-containing peptide sequence
HRKVGVENPKR

SEQ ID NO: 1697 - protein, 11 aa, Artificial
  IGFBP-2 heparin binding domain-containing peptide sequence
KHRVGVENPKR

SEQ ID NO: 1698 - protein, 11 aa, Artificial
  IGFBP-2 heparin binding domain-containing peptide sequence
RHRVGVENPKR

SEQ ID NO: 1699 - protein, 11 aa, Artificial
  IGFBP-2 heparin binding domain-containing peptide sequence
HHRVGVENPKR

SEQ ID NO: 1700 - protein, 11 aa, Artificial
  IGFBP-2 heparin binding domain-containing peptide sequence
KKRVGVENPKR

SEQ ID NO: 1701 - protein, 11 aa, Artificial
  IGFBP-2 heparin binding domain-containing peptide sequence
RKRVGVENPKR

SEQ ID NO: 1702 - protein, 11 aa, Artificial
  IGFBP-2 heparin binding domain-containing peptide sequence
HKRVGVENPKR

SEQ ID NO: 1703 - protein, 11 aa, Artificial
  IGFBP-2 heparin binding domain-containing peptide sequence
KRRVGVENPKR

SEQ ID NO: 1704 - protein, 11 aa, Artificial
  IGFBP-2 heparin binding domain-containing peptide sequence
RRRVGVENPKR

SEQ ID NO: 1705 - protein, 11 aa, Artificial
  IGFBP-2 heparin binding domain-containing peptide sequence
HRRVGVENPKR

SEQ ID NO: 1706 - protein, 11 aa, Artificial
  IGFBP-2 heparin binding domain-containing peptide sequence
KHHLGLNNPKR

SEQ ID NO: 1707 - protein, 11 aa, Artificial
  IGFBP-2 heparin binding domain-containing peptide sequence
RHHLGLNNPKR

SEQ ID NO: 1708 - protein, 11 aa, Artificial
  IGFBP-2 heparin binding domain-containing peptide sequence
HHHLGLNNPKR

SEQ ID NO: 1709 - protein, 11 aa, Artificial
  IGFBP-2 heparin binding domain-containing peptide sequence
KKHLGLNNPKR

SEQ ID NO: 1710 - protein, 11 aa, Artificial
  IGFBP-2 heparin binding domain-containing peptide sequence
RKHLGLNNPKR

SEQ ID NO: 1711 - protein, 11 aa, Artificial
  IGFBP-2 heparin binding domain-containing peptide sequence
HKHLGLNNPKR

SEQ ID NO: 1712 - protein, 11 aa, Artificial
  IGFBP-2 heparin binding domain-containing peptide sequence
KRHLGLNNPKR

SEQ ID NO: 1713 - protein, 11 aa, Artificial
  IGFBP-2 heparin binding domain-containing peptide sequence
RRHLGLNNPKR

SEQ ID NO: 1714 - protein, 11 aa, Artificial
  IGFBP-2 heparin binding domain-containing peptide sequence
HRHLGLNNPKR

SEQ ID NO: 1715 - protein, 11 aa, Artificial
  IGFBP-2 heparin binding domain-containing peptide sequence
KHKLGLNNPKR

SEQ ID NO: 1716 - protein, 11 aa, Artificial
  IGFBP-2 heparin binding domain-containing peptide sequence
RHKLGLNNPKR

SEQ ID NO: 1717 - protein, 11 aa, Artificial
  IGFBP-2 heparin binding domain-containing peptide sequence
HHKLGLNNPKR

SEQ ID NO: 1718 - protein, 11 aa, Artificial
  IGFBP-2 heparin binding domain-containing peptide sequence
KKKLGLNNPKR

SEQ ID NO: 1719 - protein, 11 aa, Artificial
  IGFBP-2 heparin binding domain-containing peptide sequence
RKKLGLNNPKR

SEQ ID NO: 1720 - protein, 11 aa, Artificial
  IGFBP-2 heparin binding domain-containing peptide sequence
HKKLGLNNPKR

SEQ ID NO: 1721 - protein, 11 aa, Artificial
  IGFBP-2 heparin binding domain-containing peptide sequence
KRKLGLNNPKR

SEQ ID NO: 1722 - protein, 11 aa, Artificial
  IGFBP-2 heparin binding domain-containing peptide sequence
RRKLGLNNPKR

SEQ ID NO: 1723 - protein, 11 aa, Artificial
  IGFBP-2 heparin binding domain-containing peptide sequence
HRKLGLNNPKR

SEQ ID NO: 1724 - protein, 11 aa, Artificial
  IGFBP-2 heparin binding domain-containing peptide sequence
KHRLGLNNPKR

SEQ ID NO: 1725 - protein, 11 aa, Artificial
  IGFBP-2 heparin binding domain-containing peptide sequence
RHRLGLNNPKR

SEQ ID NO: 1726 - protein, 11 aa, Artificial
  IGFBP-2 heparin binding domain-containing peptide sequence
HHRLGLNNPKR

SEQ ID NO: 1727 - protein, 11 aa, Artificial
  IGFBP-2 heparin binding domain-containing peptide sequence
KKRLGLNNPKR

SEQ ID NO: 1728 - protein, 11 aa, Artificial
  IGFBP-2 heparin binding domain-containing peptide sequence
RKRLGLNNPKR

SEQ ID NO: 1729 - protein, 11 aa, Artificial
  IGFBP-2 heparin binding domain-containing peptide sequence
HKRLGLNNPKR

SEQ ID NO: 1730 - protein, 11 aa, Artificial
  IGFBP-2 heparin binding domain-containing peptide sequence
KRRLGLNNPKR

SEQ ID NO: 1731 - protein, 11 aa, Artificial
  IGFBP-2 heparin binding domain-containing peptide sequence
RRRLGLNNPKR

SEQ ID NO: 1732 - protein, 11 aa, Artificial
  IGFBP-2 heparin binding domain-containing peptide sequence
HRRLGLNNPKR

SEQ ID NO: 1733 - protein, 11 aa, Artificial
  IGFBP-2 heparin binding domain-containing peptide sequence
KHHIGLNNPKR

SEQ ID NO: 1734 - protein, 11 aa, Artificial
  IGFBP-2 heparin binding domain-containing peptide sequence
RHHIGLNNPKR

SEQ ID NO: 1735 - protein, 11 aa, Artificial
  IGFBP-2 heparin binding domain-containing peptide sequence
HHHIGLNNPKR

SEQ ID NO: 1736 - protein, 11 aa, Artificial
  IGFBP-2 heparin binding domain-containing peptide sequence
KKHIGLNNPKR

SEQ ID NO: 1737 - protein, 11 aa, Artificial
  IGFBP-2 heparin binding domain-containing peptide sequence
RKHIGLNNPKR

SEQ ID NO: 1738 - protein, 11 aa, Artificial
  IGFBP-2 heparin binding domain-containing peptide sequence
HKHIGLNNPKR

SEQ ID NO: 1739 - protein, 11 aa, Artificial
  IGFBP-2 heparin binding domain-containing peptide sequence
KRHIGLNNPKR

SEQ ID NO: 1740 - protein, 11 aa, Artificial
  IGFBP-2 heparin binding domain-containing peptide sequence
RRHIGLNNPKR

SEQ ID NO: 1741 - protein, 11 aa, Artificial
  IGFBP-2 heparin binding domain-containing peptide sequence
HRHIGLNNPKR

SEQ ID NO: 1742 - protein, 11 aa, Artificial
  IGFBP-2 heparin binding domain-containing peptide sequence
KHKIGLNNPKR

SEQ ID NO: 1743 - protein, 11 aa, Artificial
  IGFBP-2 heparin binding domain-containing peptide sequence
RHKIGLNNPKR

SEQ ID NO: 1744 - protein, 11 aa, Artificial
  IGFBP-2 heparin binding domain-containing peptide sequence
HHKIGLNNPKR

SEQ ID NO: 1745 - protein, 11 aa, Artificial
  IGFBP-2 heparin binding domain-containing peptide sequence
KKKIGLNNPKR

SEQ ID NO: 1746 - protein, 11 aa, Artificial
  IGFBP-2 heparin binding domain-containing peptide sequence
RKKIGLNNPKR

SEQ ID NO: 1747 - protein, 11 aa, Artificial
  IGFBP-2 heparin binding domain-containing peptide sequence
HKKIGLNNPKR

SEQ ID NO: 1748 - protein, 11 aa, Artificial
  IGFBP-2 heparin binding domain-containing peptide sequence
KRKIGLNNPKR

SEQ ID NO: 1749 - protein, 11 aa, Artificial
  IGFBP-2 heparin binding domain-containing peptide sequence
RRKIGLNNPKR

SEQ ID NO: 1750 - protein, 11 aa, Artificial
  IGFBP-2 heparin binding domain-containing peptide sequence
HRKIGLNNPKR

SEQ ID NO: 1751 - protein, 11 aa, Artificial
  IGFBP-2 heparin binding domain-containing peptide sequence
KHRIGLNNPKR

SEQ ID NO: 1752 - protein, 11 aa, Artificial
  IGFBP-2 heparin binding domain-containing peptide sequence
RHRIGLNNPKR

SEQ ID NO: 1753 - protein, 11 aa, Artificial
  IGFBP-2 heparin binding domain-containing peptide sequence
HHRIGLNNPKR

SEQ ID NO: 1754 - protein, 11 aa, Artificial
  IGFBP-2 heparin binding domain-containing peptide sequence
KKRIGLNNPKR

SEQ ID NO: 1755 - protein, 11 aa, Artificial
  IGFBP-2 heparin binding domain-containing peptide sequence
RKRIGLNNPKR

SEQ ID NO: 1756 - protein, 11 aa, Artificial
  IGFBP-2 heparin binding domain-containing peptide sequence
HKRIGLNNPKR

SEQ ID NO: 1757 - protein, 11 aa, Artificial
  IGFBP-2 heparin binding domain-containing peptide sequence
KRRIGLNNPKR

SEQ ID NO: 1758 - protein, 11 aa, Artificial
  IGFBP-2 heparin binding domain-containing peptide sequence
RRRIGLNNPKR

SEQ ID NO: 1759 - protein, 11 aa, Artificial
  IGFBP-2 heparin binding domain-containing peptide sequence
HRRIGLNNPKR

SEQ ID NO: 1760 - protein, 11 aa, Artificial
  IGFBP-2 heparin binding domain-containing peptide sequence
KHHVGLNNPKR

SEQ ID NO: 1761 - protein, 11 aa, Artificial
  IGFBP-2 heparin binding domain-containing peptide sequence
RHHVGLNNPKR

SEQ ID NO: 1762 - protein, 11 aa, Artificial
  IGFBP-2 heparin binding domain-containing peptide sequence
HHHVGLNNPKR

SEQ ID NO: 1763 - protein, 11 aa, Artificial
  IGFBP-2 heparin binding domain-containing peptide sequence
KKHVGLNNPKR

SEQ ID NO: 1764 - protein, 11 aa, Artificial
  IGFBP-2 heparin binding domain-containing peptide sequence
RKHVGLNNPKR

SEQ ID NO: 1765 - protein, 11 aa, Artificial
  IGFBP-2 heparin binding domain-containing peptide sequence
HKHVGLNNPKR

SEQ ID NO: 1766 - protein, 11 aa, Artificial
  IGFBP-2 heparin binding domain-containing peptide sequence
KRHVGLNNPKR

SEQ ID NO: 1767 - protein, 11 aa, Artificial
  IGFBP-2 heparin binding domain-containing peptide sequence
RRHVGLNNPKR

SEQ ID NO: 1768 - protein, 11 aa, Artificial
  IGFBP-2 heparin binding domain-containing peptide sequence
HRHVGLNNPKR

SEQ ID NO: 1769 - protein, 11 aa, Artificial
  IGFBP-2 heparin binding domain-containing peptide sequence
KHKVGLNNPKR

SEQ ID NO: 1770 - protein, 11 aa, Artificial
  IGFBP-2 heparin binding domain-containing peptide sequence
RHKVGLNNPKR

SEQ ID NO: 1771 - protein, 11 aa, Artificial
  IGFBP-2 heparin binding domain-containing peptide sequence
HHKVGLNNPKR

SEQ ID NO: 1772 - protein, 11 aa, Artificial
  IGFBP-2 heparin binding domain-containing peptide sequence
KKKVGLNNPKR

SEQ ID NO: 1773 - protein, 11 aa, Artificial
  IGFBP-2 heparin binding domain-containing peptide sequence
RKKVGLNNPKR

SEQ ID NO: 1774 - protein, 11 aa, Artificial
  IGFBP-2 heparin binding domain-containing peptide sequence
HKKVGLNNPKR

SEQ ID NO: 1775 - protein, 11 aa, Artificial
  IGFBP-2 heparin binding domain-containing peptide sequence
KRKVGLNNPKR

SEQ ID NO: 1776 - protein, 11 aa, Artificial
  IGFBP-2 heparin binding domain-containing peptide sequence
RRKVGLNNPKR

SEQ ID NO: 1777 - protein, 11 aa, Artificial
  IGFBP-2 heparin binding domain-containing peptide sequence
HRKVGLNNPKR

SEQ ID NO: 1778 - protein, 11 aa, Artificial
  IGFBP-2 heparin binding domain-containing peptide sequence
KHRVGLNNPKR

SEQ ID NO: 1779 - protein, 11 aa, Artificial
  IGFBP-2 heparin binding domain-containing peptide sequence
RHRVGLNNPKR

SEQ ID NO: 1780 - protein, 11 aa, Artificial
  IGFBP-2 heparin binding domain-containing peptide sequence
HHRVGLNNPKR

SEQ ID NO: 1781 - protein, 11 aa, Artificial
  IGFBP-2 heparin binding domain-containing peptide sequence
KKRVGLNNPKR

SEQ ID NO: 1782 - protein, 11 aa, Artificial
  IGFBP-2 heparin binding domain-containing peptide sequence
RKRVGLNNPKR

SEQ ID NO: 1783 - protein, 11 aa, Artificial
  IGFBP-2 heparin binding domain-containing peptide sequence
HKRVGLNNPKR

SEQ ID NO: 1784 - protein, 11 aa, Artificial
  IGFBP-2 heparin binding domain-containing peptide sequence
KRRVGLNNPKR

SEQ ID NO: 1785 - protein, 11 aa, Artificial
  IGFBP-2 heparin binding domain-containing peptide sequence
RRRVGLNNPKR

SEQ ID NO: 1786 - protein, 11 aa, Artificial
  IGFBP-2 heparin binding domain-containing peptide sequence
HRRVGLNNPKR

SEQ ID NO: 1787 - protein, 11 aa, Artificial
  IGFBP-2 heparin binding domain-containing peptide sequence
KHHLGINNPKR

SEQ ID NO: 1788 - protein, 11 aa, Artificial
  IGFBP-2 heparin binding domain-containing peptide sequence
RHHLGINNPKR

SEQ ID NO: 1789 - protein, 11 aa, Artificial
  IGFBP-2 heparin binding domain-containing peptide sequence
HHHLGINNPKR

SEQ ID NO: 1790 - protein, 11 aa, Artificial
  IGFBP-2 heparin binding domain-containing peptide sequence
KKHLGINNPKR

SEQ ID NO: 1791 - protein, 11 aa, Artificial
  IGFBP-2 heparin binding domain-containing peptide sequence
RKHLGINNPKR

SEQ ID NO: 1792 - protein, 11 aa, Artificial
  IGFBP-2 heparin binding domain-containing peptide sequence
HKHLGINNPKR

SEQ ID NO: 1793 - protein, 11 aa, Artificial
  IGFBP-2 heparin binding domain-containing peptide sequence
KRHLGINNPKR

SEQ ID NO: 1794 - protein, 11 aa, Artificial
  IGFBP-2 heparin binding domain-containing peptide sequence
RRHLGINNPKR

SEQ ID NO: 1795 - protein, 11 aa, Artificial
  IGFBP-2 heparin binding domain-containing peptide sequence
HRHLGINNPKR

SEQ ID NO: 1796 - protein, 11 aa, Artificial
  IGFBP-2 heparin binding domain-containing peptide sequence
KHKLGINNPKR

SEQ ID NO: 1797 - protein, 11 aa, Artificial
  IGFBP-2 heparin binding domain-containing peptide sequence
RHKLGINNPKR

SEQ ID NO: 1798 - protein, 11 aa, Artificial
  IGFBP-2 heparin binding domain-containing peptide sequence
HHKLGINNPKR

SEQ ID NO: 1799 - protein, 11 aa, Artificial
  IGFBP-2 heparin binding domain-containing peptide sequence
KKKLGINNPKR

SEQ ID NO: 1800 - protein, 11 aa, Artificial
  IGFBP-2 heparin binding domain-containing peptide sequence
RKKLGINNPKR

SEQ ID NO: 1801 - protein, 11 aa, Artificial
  IGFBP-2 heparin binding domain-containing peptide sequence
HKKLGINNPKR

SEQ ID NO: 1802 - protein, 11 aa, Artificial
  IGFBP-2 heparin binding domain-containing peptide sequence
KRKLGINNPKR

SEQ ID NO: 1803 - protein, 11 aa, Artificial
  IGFBP-2 heparin binding domain-containing peptide sequence
RRKLGINNPKR

SEQ ID NO: 1804 - protein, 11 aa, Artificial
  IGFBP-2 heparin binding domain-containing peptide sequence
HRKLGINNPKR

SEQ ID NO: 1805 - protein, 11 aa, Artificial
  IGFBP-2 heparin binding domain-containing peptide sequence
KHRLGINNPKR

SEQ ID NO: 1806 - protein, 11 aa, Artificial
  IGFBP-2 heparin binding domain-containing peptide sequence
RHRLGINNPKR

SEQ ID NO: 1807 - protein, 11 aa, Artificial
  IGFBP-2 heparin binding domain-containing peptide sequence
HHRLGINNPKR

SEQ ID NO: 1808 - protein, 11 aa, Artificial
  IGFBP-2 heparin binding domain-containing peptide sequence
KKRLGINNPKR

SEQ ID NO: 1809 - protein, 11 aa, Artificial
  IGFBP-2 heparin binding domain-containing peptide sequence
RKRLGINNPKR

SEQ ID NO: 1810 - protein, 11 aa, Artificial
  IGFBP-2 heparin binding domain-containing peptide sequence
HKRLGINNPKR

SEQ ID NO: 1811 - protein, 11 aa, Artificial
  IGFBP-2 heparin binding domain-containing peptide sequence
KRRLGINNPKR

SEQ ID NO: 1812 - protein, 11 aa, Artificial
  IGFBP-2 heparin binding domain-containing peptide sequence
RRRLGINNPKR

SEQ ID NO: 1813 - protein, 11 aa, Artificial
  IGFBP-2 heparin binding domain-containing peptide sequence
HRRLGINNPKR

SEQ ID NO: 1814 - protein, 11 aa, Artificial
  IGFBP-2 heparin binding domain-containing peptide sequence
KHHIGIENPKR

SEQ ID NO: 1815 - protein, 11 aa, Artificial
  IGFBP-2 heparin binding domain-containing peptide sequence
RHHIGINNPKR

SEQ ID NO: 1816 - protein, 11 aa, Artificial
  IGFBP-2 heparin binding domain-containing peptide sequence
HHHIGINNPKR

SEQ ID NO: 1817 - protein, 11 aa, Artificial
  IGFBP-2 heparin binding domain-containing peptide sequence
KKHIGINNPKR

SEQ ID NO: 1818 - protein, 11 aa, Artificial
  IGFBP-2 heparin binding domain-containing peptide sequence
RKHIGINNPKR

SEQ ID NO: 1819 - protein, 11 aa, Artificial
  IGFBP-2 heparin binding domain-containing peptide sequence
HKHIGINNPKR

SEQ ID NO: 1820 - protein, 11 aa, Artificial
  IGFBP-2 heparin binding domain-containing peptide sequence
KRHIGINNPKR

SEQ ID NO: 1821 - protein, 11 aa, Artificial
  IGFBP-2 heparin binding domain-containing peptide sequence
RRHIGINNPKR

SEQ ID NO: 1822 - protein, 11 aa, Artificial
  IGFBP-2 heparin binding domain-containing peptide sequence
HRHIGINNPKR

SEQ ID NO: 1823 - protein, 11 aa, Artificial
  IGFBP-2 heparin binding domain-containing peptide sequence
KHKIGINNPKR

SEQ ID NO: 1824 - protein, 11 aa, Artificial
  IGFBP-2 heparin binding domain-containing peptide sequence
RHKIGINNPKR

SEQ ID NO: 1825 - protein, 11 aa, Artificial
  IGFBP-2 heparin binding domain-containing peptide sequence
HHKIGINNPKR

SEQ ID NO: 1826 - protein, 11 aa, Artificial
  IGFBP-2 heparin binding domain-containing peptide sequence
KKKIGINNPKR

SEQ ID NO: 1827 - protein, 11 aa, Artificial
  IGFBP-2 heparin binding domain-containing peptide sequence
RKKIGINNPKR

SEQ ID NO: 1828 - protein, 11 aa, Artificial
  IGFBP-2 heparin binding domain-containing peptide sequence
HKKIGINNPKR

SEQ ID NO: 1829 - protein, 11 aa, Artificial
  IGFBP-2 heparin binding domain-containing peptide sequence
KRKIGINNPKR

SEQ ID NO: 1830 - protein, 11 aa, Artificial
  IGFBP-2 heparin binding domain-containing peptide sequence
RRKIGINNPKR

SEQ ID NO: 1831 - protein, 11 aa, Artificial
  IGFBP-2 heparin binding domain-containing peptide sequence
HRKIGINNPKR

SEQ ID NO: 1832 - protein, 11 aa, Artificial
  IGFBP-2 heparin binding domain-containing peptide sequence
KHRIGINNPKR

SEQ ID NO: 1833 - protein, 11 aa, Artificial
  IGFBP-2 heparin binding domain-containing peptide sequence
RHRIGINNPKR

SEQ ID NO: 1834 - protein, 11 aa, Artificial
  IGFBP-2 heparin binding domain-containing peptide sequence
HHRIGINNPKR

SEQ ID NO: 1835 - protein, 11 aa, Artificial
  IGFBP-2 heparin binding domain-containing peptide sequence
KKRIGINNPKR

SEQ ID NO: 1836 - protein, 11 aa, Artificial
  IGFBP-2 heparin binding domain-containing peptide sequence
RKRIGINNPKR

SEQ ID NO: 1837 - protein, 11 aa, Artificial
  IGFBP-2 heparin binding domain-containing peptide sequence
HKRIGINNPKR

SEQ ID NO: 1838 - protein, 11 aa, Artificial
  IGFBP-2 heparin binding domain-containing peptide sequence
KRRIGINNPKR

SEQ ID NO: 1839 - protein, 11 aa, Artificial
  IGFBP-2 heparin binding domain-containing peptide sequence
RRRIGINNPKR

SEQ ID NO: 1840 - protein, 11 aa, Artificial
  IGFBP-2 heparin binding domain-containing peptide sequence
HRRIGINNPKR

SEQ ID NO: 1841 - protein, 11 aa, Artificial
  IGFBP-2 heparin binding domain-containing peptide sequence
KHHVGINNPKR

SEQ ID NO: 1842 - protein, 11 aa, Artificial
  IGFBP-2 heparin binding domain-containing peptide sequence
RHHVGINNPKR

SEQ ID NO: 1843 - protein, 11 aa, Artificial
  IGFBP-2 heparin binding domain-containing peptide sequence
HHHVGINNPKR

SEQ ID NO: 1844 - protein, 11 aa, Artificial
  IGFBP-2 heparin binding domain-containing peptide sequence
KKHVGINNPKR

SEQ ID NO: 1845 - protein, 11 aa, Artificial
  IGFBP-2 heparin binding domain-containing peptide sequence
RKHVGINNPKR

SEQ ID NO: 1846 - protein, 11 aa, Artificial
  IGFBP-2 heparin binding domain-containing peptide sequence
HKHVGINNPKR

SEQ ID NO: 1847 - protein, 11 aa, Artificial
  IGFBP-2 heparin binding domain-containing peptide sequence
KRHVGINNPKR

SEQ ID NO: 1848 - protein, 11 aa, Artificial
  IGFBP-2 heparin binding domain-containing peptide sequence
RRHVGINNPKR

SEQ ID NO: 1849 - protein, 11 aa, Artificial
  IGFBP-2 heparin binding domain-containing peptide sequence
HRHVGINNPKR

SEQ ID NO: 1850 - protein, 11 aa, Artificial
  IGFBP-2 heparin binding domain-containing peptide sequence
KHKVGINNPKR

SEQ ID NO: 1851 - protein, 11 aa, Artificial
  IGFBP-2 heparin binding domain-containing peptide sequence
RHKVGINNPKR

SEQ ID NO: 1852 - protein, 11 aa, Artificial
  IGFBP-2 heparin binding domain-containing peptide sequence
HHKVGINNPKR

SEQ ID NO: 1853 - protein, 11 aa, Artificial
  IGFBP-2 heparin binding domain-containing peptide sequence
KKKVGINNPKR

SEQ ID NO: 1854 - protein, 11 aa, Artificial
  IGFBP-2 heparin binding domain-containing peptide sequence
RKKVGINNPKR

SEQ ID NO: 1855 - protein, 11 aa, Artificial
  IGFBP-2 heparin binding domain-containing peptide sequence
HKKVGINNPKR

SEQ ID NO: 1856 - protein, 11 aa, Artificial
  IGFBP-2 heparin binding domain-containing peptide sequence
KRKVGINNPKR

SEQ ID NO: 1857 - protein, 11 aa, Artificial
  IGFBP-2 heparin binding domain-containing peptide sequence
RRKVGINNPKR

SEQ ID NO: 1858 - protein, 11 aa, Artificial
  IGFBP-2 heparin binding domain-containing peptide sequence
HRKVGINNPKR

SEQ ID NO: 1859 - protein, 11 aa, Artificial
  IGFBP-2 heparin binding domain-containing peptide sequence
KHRVGINNPKR

SEQ ID NO: 1860 - protein, 11 aa, Artificial
  IGFBP-2 heparin binding domain-containing peptide sequence
RHRVGINNPKR

SEQ ID NO: 1861 - protein, 11 aa, Artificial
  IGFBP-2 heparin binding domain-containing peptide sequence
HHRVGINNPKR

SEQ ID NO: 1862 - protein, 11 aa, Artificial
  IGFBP-2 heparin binding domain-containing peptide sequence
KKRVGINNPKR

SEQ ID NO: 1863 - protein, 11 aa, Artificial
  IGFBP-2 heparin binding domain-containing peptide sequence
RKRVGINNPKR

SEQ ID NO: 1864 - protein, 11 aa, Artificial
  IGFBP-2 heparin binding domain-containing peptide sequence
HKRVGINNPKR

SEQ ID NO: 1865 - protein, 11 aa, Artificial
  IGFBP-2 heparin binding domain-containing peptide sequence
KRRVGINNPKR

SEQ ID NO: 1866 - protein, 11 aa, Artificial
  IGFBP-2 heparin binding domain-containing peptide sequence
RRRVGINNPKR

SEQ ID NO: 1867 - protein, 11 aa, Artificial
  IGFBP-2 heparin binding domain-containing peptide sequence
HRRVGINNPKR

SEQ ID NO: 1868 - protein, 11 aa, Artificial
  IGFBP-2 heparin binding domain-containing peptide sequence
KHHLGVNNPKR

SEQ ID NO: 1869 - protein, 11 aa, Artificial
  IGFBP-2 heparin binding domain-containing peptide sequence
RHHLGVNNPKR

SEQ ID NO: 1870 - protein, 11 aa, Artificial
  IGFBP-2 heparin binding domain-containing peptide sequence
HHHLGVNNPKR

SEQ ID NO: 1871 - protein, 11 aa, Artificial
  IGFBP-2 heparin binding domain-containing peptide sequence
KKHLGVNNPKR

SEQ ID NO: 1872 - protein, 11 aa, Artificial
  IGFBP-2 heparin binding domain-containing peptide sequence
RKHLGVNNPKR

SEQ ID NO: 1873 - protein, 11 aa, Artificial
  IGFBP-2 heparin binding domain-containing peptide sequence
HKHLGVNNPKR

SEQ ID NO: 1874 - protein, 11 aa, Artificial
  IGFBP-2 heparin binding domain-containing peptide sequence
KRHLGVNNPKR

SEQ ID NO: 1875 - protein, 11 aa, Artificial
  IGFBP-2 heparin binding domain-containing peptide sequence
RRHLGVNNPKR

SEQ ID NO: 1876 - protein, 11 aa, Artificial
  IGFBP-2 heparin binding domain-containing peptide sequence
HRHLGVNNPKR

SEQ ID NO: 1877 - protein, 11 aa, Artificial
  IGFBP-2 heparin binding domain-containing peptide sequence
KHKLGVNNPKR

SEQ ID NO: 1878 - protein, 11 aa, Artificial
  IGFBP-2 heparin binding domain-containing peptide sequence
RHKLGVNNPKR

SEQ ID NO: 1879 - protein, 11 aa, Artificial
  IGFBP-2 heparin binding domain-containing peptide sequence
HHKLGVNNPKR

SEQ ID NO: 1880 - protein, 11 aa, Artificial
  IGFBP-2 heparin binding domain-containing peptide sequence
KKKLGVNNPKR

SEQ ID NO: 1881 - protein, 11 aa, Artificial
  IGFBP-2 heparin binding domain-containing peptide sequence
RKKLGVNNPKR

SEQ ID NO: 1882 - protein, 11 aa, Artificial
  IGFBP-2 heparin binding domain-containing peptide sequence
HKKLGVNNPKR

SEQ ID NO: 1883 - protein, 11 aa, Artificial
  IGFBP-2 heparin binding domain-containing peptide sequence
KRKLGVNNPKR

SEQ ID NO: 1884 - protein, 11 aa, Artificial
  IGFBP-2 heparin binding domain-containing peptide sequence
RRKLGVNNPKR

SEQ ID NO: 1885 - protein, 11 aa, Artificial
  IGFBP-2 heparin binding domain-containing peptide sequence
HRKLGVNNPKR

SEQ ID NO: 1886 - protein, 11 aa, Artificial
  IGFBP-2 heparin binding domain-containing peptide sequence
KHRLGVNNPKR

SEQ ID NO: 1887 - protein, 11 aa, Artificial
  IGFBP-2 heparin binding domain-containing peptide sequence
RHRLGVNNPKR

SEQ ID NO: 1888 - protein, 11 aa, Artificial
  IGFBP-2 heparin binding domain-containing peptide sequence
HHRLGVNNPKR

SEQ ID NO: 1889 - protein, 11 aa, Artificial
  IGFBP-2 heparin binding domain-containing peptide sequence
KKRLGVNNPKR

SEQ ID NO: 1890 - protein, 11 aa, Artificial
  IGFBP-2 heparin binding domain-containing peptide sequence
RKRLGVNNPKR

SEQ ID NO: 1891 - protein, 11 aa, Artificial
  IGFBP-2 heparin binding domain-containing peptide sequence
HKRLGVNNPKR

SEQ ID NO: 1892 - protein, 11 aa, Artificial
  IGFBP-2 heparin binding domain-containing peptide sequence
KRRLGVNNPKR

SEQ ID NO: 1893 - protein, 11 aa, Artificial
  IGFBP-2 heparin binding domain-containing peptide sequence
RRRLGVNNPKR

SEQ ID NO: 1894 - protein, 11 aa, Artificial
  IGFBP-2 heparin binding domain-containing peptide sequence
HRRLGVNNPKR

SEQ ID NO: 1895 - protein, 11 aa, Artificial
  IGFBP-2 heparin binding domain-containing peptide sequence
KHHIGVNNPKR

SEQ ID NO: 1896 - protein, 11 aa, Artificial
  IGFBP-2 heparin binding domain-containing peptide sequence
RHHIGVNNPKR

SEQ ID NO: 1897 - protein, 11 aa, Artificial
  IGFBP-2 heparin binding domain-containing peptide sequence
HHHIGVNNPKR

SEQ ID NO: 1898 - protein, 11 aa, Artificial
  IGFBP-2 heparin binding domain-containing peptide sequence
KKHIGVNNPKR

SEQ ID NO: 1899 - protein, 11 aa, Artificial
  IGFBP-2 heparin binding domain-containing peptide sequence
RKHIGVNNPKR

SEQ ID NO: 1900 - protein, 11 aa, Artificial
  IGFBP-2 heparin binding domain-containing peptide sequence
HKHIGVNNPKR

SEQ ID NO: 1901 - protein, 11 aa, Artificial
  IGFBP-2 heparin binding domain-containing peptide sequence
KRHIGVNNPKR

SEQ ID NO: 1902 - protein, 11 aa, Artificial
  IGFBP-2 heparin binding domain-containing peptide sequence
RRHIGVNNPKR

SEQ ID NO: 1903 - protein, 11 aa, Artificial
  IGFBP-2 heparin binding domain-containing peptide sequence
HRHIGVNNPKR

SEQ ID NO: 1904 - protein, 11 aa, Artificial
  IGFBP-2 heparin binding domain-containing peptide sequence
KHKIGVNNPKR

SEQ ID NO: 1905 - protein, 11 aa, Artificial
  IGFBP-2 heparin binding domain-containing peptide sequence
RHKIGVNNPKR

SEQ ID NO: 1906 - protein, 11 aa, Artificial
  IGFBP-2 heparin binding domain-containing peptide sequence
HHKIGVNNPKR

SEQ ID NO: 1907 - protein, 11 aa, Artificial
  IGFBP-2 heparin binding domain-containing peptide sequence
KKKIGVNNPKR

SEQ ID NO: 1908 - protein, 11 aa, Artificial
  IGFBP-2 heparin binding domain-containing peptide sequence
RKKIGVNNPKR

SEQ ID NO: 1909 - protein, 11 aa, Artificial
  IGFBP-2 heparin binding domain-containing peptide sequence
HKKIGVNNPKR

SEQ ID NO: 1910 - protein, 11 aa, Artificial
  IGFBP-2 heparin binding domain-containing peptide sequence
KRKIGVNNPKR

SEQ ID NO: 1911 - protein, 11 aa, Artificial
  IGFBP-2 heparin binding domain-containing peptide sequence
RRKIGVNNPKR

SEQ ID NO: 1912 - protein, 11 aa, Artificial
  IGFBP-2 heparin binding domain-containing peptide sequence
HRKIGVNNPKR

SEQ ID NO: 1913 - protein, 11 aa, Artificial
  IGFBP-2 heparin binding domain-containing peptide sequence
KHRIGVNNPKR

SEQ ID NO: 1914 - protein, 11 aa, Artificial
  IGFBP-2 heparin binding domain-containing peptide sequence
RHRIGVNNPKR

SEQ ID NO: 1915 - protein, 11 aa, Artificial
  IGFBP-2 heparin binding domain-containing peptide sequence
HHRIGVNNPKR

SEQ ID NO: 1916 - protein, 11 aa, Artificial
  IGFBP-2 heparin binding domain-containing peptide sequence
KKRIGVNNPKR

SEQ ID NO: 1917 - protein, 11 aa, Artificial
  IGFBP-2 heparin binding domain-containing peptide sequence
RKRIGVNNPKR

SEQ ID NO: 1918 - protein, 11 aa, Artificial
  IGFBP-2 heparin binding domain-containing peptide sequence
HKRIGVNNPKR

SEQ ID NO: 1919 - protein, 11 aa, Artificial
  IGFBP-2 heparin binding domain-containing peptide sequence
KRRIGVNNPKR

SEQ ID NO: 1920 - protein, 11 aa, Artificial
  IGFBP-2 heparin binding domain-containing peptide sequence
RRRIGVNNPKR

SEQ ID NO: 1921 - protein, 11 aa, Artificial
  IGFBP-2 heparin binding domain-containing peptide sequence
HRRIGVNNPKR

SEQ ID NO: 1922 - protein, 11 aa, Artificial
  IGFBP-2 heparin binding domain-containing peptide sequence
KHHVGVNNPKR

SEQ ID NO: 1923 - protein, 11 aa, Artificial
  IGFBP-2 heparin binding domain-containing peptide sequence
RHHVGVNNPKR

SEQ ID NO: 1924 - protein, 11 aa, Artificial
  IGFBP-2 heparin binding domain-containing peptide sequence
HHHVGVNNPKR

SEQ ID NO: 1925 - protein, 11 aa, Artificial
  IGFBP-2 heparin binding domain-containing peptide sequence
KKHVGVNNPKR

SEQ ID NO: 1926 - protein, 11 aa, Artificial
  IGFBP-2 heparin binding domain-containing peptide sequence
RKHVGVNNPKR

SEQ ID NO: 1927 - protein, 11 aa, Artificial
  IGFBP-2 heparin binding domain-containing peptide sequence
HKHVGVNNPKR

SEQ ID NO: 1928 - protein, 11 aa, Artificial
  IGFBP-2 heparin binding domain-containing peptide sequence
KRHVGVNNPKR

SEQ ID NO: 1929 - protein, 11 aa, Artificial
  IGFBP-2 heparin binding domain-containing peptide sequence
RRHVGVNNPKR

SEQ ID NO: 1930 - protein, 11 aa, Artificial
  IGFBP-2 heparin binding domain-containing peptide sequence
HRHVGVNNPKR

SEQ ID NO: 1931 - protein, 11 aa, Artificial
  IGFBP-2 heparin binding domain-containing peptide sequence
KHKVGVNNPKR

SEQ ID NO: 1932 - protein, 11 aa, Artificial
  IGFBP-2 heparin binding domain-containing peptide sequence
RHKVGVNNPKR

SEQ ID NO: 1933 - protein, 11 aa, Artificial
  IGFBP-2 heparin binding domain-containing peptide sequence
HHKVGVNNPKR

SEQ ID NO: 1934 - protein, 11 aa, Artificial
  IGFBP-2 heparin binding domain-containing peptide sequence
KKKVGVNNPKR

SEQ ID NO: 1935 - protein, 11 aa, Artificial
  IGFBP-2 heparin binding domain-containing peptide sequence
RKKVGVNNPKR

SEQ ID NO: 1936 - protein, 11 aa, Artificial
  IGFBP-2 heparin binding domain-containing peptide sequence
HKKVGVNNPKR

SEQ ID NO: 1937 - protein, 11 aa, Artificial
  IGFBP-2 heparin binding domain-containing peptide sequence
KRKVGVNNPKR

SEQ ID NO: 1938 - protein, 11 aa, Artificial
  IGFBP-2 heparin binding domain-containing peptide sequence
RRKVGVNNPKR

SEQ ID NO: 1939 - protein, 11 aa, Artificial
  IGFBP-2 heparin binding domain-containing peptide sequence
HRKVGVNNPKR

SEQ ID NO: 1940 - protein, 11 aa, Artificial
  IGFBP-2 heparin binding domain-containing peptide sequence
KHRVGVNNPKR

SEQ ID NO: 1941 - protein, 11 aa, Artificial
  IGFBP-2 heparin binding domain-containing peptide sequence
RHRVGVNNPKR

SEQ ID NO: 1942 - protein, 11 aa, Artificial
  IGFBP-2 heparin binding domain-containing peptide sequence
HHRVGVNNPKR

SEQ ID NO: 1943 - protein, 11 aa, Artificial
  IGFBP-2 heparin binding domain-containing peptide sequence
KKRVGVNNPKR

SEQ ID NO: 1944 - protein, 11 aa, Artificial
  IGFBP-2 heparin binding domain-containing peptide sequence
RKRVGVNNPKR

SEQ ID NO: 1945 - protein, 11 aa, Artificial
  IGFBP-2 heparin binding domain-containing peptide sequence
HKRVGVNNPKR

SEQ ID NO: 1946 - protein, 11 aa, Artificial
  IGFBP-2 heparin binding domain-containing peptide sequence
KRRVGVNNPKR

SEQ ID NO: 1947 - protein, 11 aa, Artificial
  IGFBP-2 heparin binding domain-containing peptide sequence
RRRVGVNNPKR

SEQ ID NO: 1948 - protein, 11 aa, Artificial
  IGFBP-2 heparin binding domain-containing peptide sequence
HRRVGVNNPKR

SEQ ID NO: 1949 - protein, 11 aa, Artificial
  IGFBP-2 heparin binding domain-containing peptide sequence
KHHLGLEEPKH

SEQ ID NO: 1950 - protein, 11 aa, Artificial
  IGFBP-2 heparin binding domain-containing peptide sequence
RHHLGLEEPKH

SEQ ID NO: 1951 - protein, 11 aa, Artificial
  IGFBP-2 heparin binding domain-containing peptide sequence
HHHLGLEEPKH

SEQ ID NO: 1952 - protein, 11 aa, Artificial
  IGFBP-2 heparin binding domain-containing peptide sequence
KKHLGLEEPKH

SEQ ID NO: 1953 - protein, 11 aa, Artificial
  IGFBP-2 heparin binding domain-containing peptide sequence
RKHLGLEEPKH

SEQ ID NO: 1954 - protein, 11 aa, Artificial
  IGFBP-2 heparin binding domain-containing peptide sequence
HKHLGLEEPKH

SEQ ID NO: 1955 - protein, 11 aa, Artificial
  IGFBP-2 heparin binding domain-containing peptide sequence
KRHLGLEEPKH

SEQ ID NO: 1956 - protein, 11 aa, Artificial
  IGFBP-2 heparin binding domain-containing peptide sequence
RRHLGLEEPKH

SEQ ID NO: 1957 - protein, 11 aa, Artificial
  IGFBP-2 heparin binding domain-containing peptide sequence
HRHLGLEEPKH

SEQ ID NO: 1958 - protein, 11 aa, Artificial
  IGFBP-2 heparin binding domain-containing peptide sequence
KHKLGLEEPKH

SEQ ID NO: 1959 - protein, 11 aa, Artificial
  IGFBP-2 heparin binding domain-containing peptide sequence
RHKLGLEEPKH

SEQ ID NO: 1960 - protein, 11 aa, Artificial
  IGFBP-2 heparin binding domain-containing peptide sequence
HHKLGLEEPKH

SEQ ID NO: 1961 - protein, 11 aa, Artificial
  IGFBP-2 heparin binding domain-containing peptide sequence
KKKLGLEEPKH

SEQ ID NO: 1962 - protein, 11 aa, Artificial
  IGFBP-2 heparin binding domain-containing peptide sequence
RKKLGLEEPKH

SEQ ID NO: 1963 - protein, 11 aa, Artificial
  IGFBP-2 heparin binding domain-containing peptide sequence
HKKLGLEEPKH

SEQ ID NO: 1964 - protein, 11 aa, Artificial
  IGFBP-2 heparin binding domain-containing peptide sequence
KRKLGLEEPKH

SEQ ID NO: 1965 - protein, 11 aa, Artificial
  IGFBP-2 heparin binding domain-containing peptide sequence
RRKLGLEEPKH

SEQ ID NO: 1966 - protein, 11 aa, Artificial
  IGFBP-2 heparin binding domain-containing peptide sequence
HRKLGLEEPKH

SEQ ID NO: 1967 - protein, 11 aa, Artificial
  IGFBP-2 heparin binding domain-containing peptide sequence
KHRLGLEEPKH

SEQ ID NO: 1968 - protein, 11 aa, Artificial
  IGFBP-2 heparin binding domain-containing peptide sequence
RHRLGLEEPKH

SEQ ID NO: 1969 - protein, 11 aa, Artificial
  IGFBP-2 heparin binding domain-containing peptide sequence
HHRLGLEEPKH

SEQ ID NO: 1970 - protein, 11 aa, Artificial
  IGFBP-2 heparin binding domain-containing peptide sequence
KKRLGLEEPKH

SEQ ID NO: 1971 - protein, 11 aa, Artificial
  IGFBP-2 heparin binding domain-containing peptide sequence
RKRLGLEEPKH

SEQ ID NO: 1972 - protein, 11 aa, Artificial
  IGFBP-2 heparin binding domain-containing peptide sequence
HKRLGLEEPKH

SEQ ID NO: 1973 - protein, 11 aa, Artificial
  IGFBP-2 heparin binding domain-containing peptide sequence
KRRLGLEEPKH

SEQ ID NO: 1974 - protein, 11 aa, Artificial
  IGFBP-2 heparin binding domain-containing peptide sequence
RRRLGLEEPKH

SEQ ID NO: 1975 - protein, 11 aa, Artificial
  IGFBP-2 heparin binding domain-containing peptide sequence
HRRLGLEEPKH

SEQ ID NO: 1976 - protein, 11 aa, Artificial
  IGFBP-2 heparin binding domain-containing peptide sequence
KHHIGLEEPKH

SEQ ID NO: 1977 - protein, 11 aa, Artificial
  IGFBP-2 heparin binding domain-containing peptide sequence
RHHIGLEEPKH

SEQ ID NO: 1978 - protein, 11 aa, Artificial
  IGFBP-2 heparin binding domain-containing peptide sequence
HHHIGLEEPKH

SEQ ID NO: 1979 - protein, 11 aa, Artificial
  IGFBP-2 heparin binding domain-containing peptide sequence
KKHIGLEEPKH

SEQ ID NO: 1980 - protein, 11 aa, Artificial
  IGFBP-2 heparin binding domain-containing peptide sequence
RKHIGLEEPKH

SEQ ID NO: 1981 - protein, 11 aa, Artificial
  IGFBP-2 heparin binding domain-containing peptide sequence
HKHIGLEEPKH

SEQ ID NO: 1982 - protein, 11 aa, Artificial
  IGFBP-2 heparin binding domain-containing peptide sequence
KRHIGLEEPKH

SEQ ID NO: 1983 - protein, 11 aa, Artificial
  IGFBP-2 heparin binding domain-containing peptide sequence
RRHIGLEEPKH

SEQ ID NO: 1984 - protein, 11 aa, Artificial
  IGFBP-2 heparin binding domain-containing peptide sequence
HRHIGLEEPKH

SEQ ID NO: 1985 - protein, 11 aa, Artificial
  IGFBP-2 heparin binding domain-containing peptide sequence
KHKIGLEEPKH

SEQ ID NO: 1986 - protein, 11 aa, Artificial
  IGFBP-2 heparin binding domain-containing peptide sequence
RHKIGLEEPKH

SEQ ID NO: 1987 - protein, 11 aa, Artificial
  IGFBP-2 heparin binding domain-containing peptide sequence
HHKIGLEEPKH

SEQ ID NO: 1988 - protein, 11 aa, Artificial
  IGFBP-2 heparin binding domain-containing peptide sequence
KKKIGLEEPKH

SEQ ID NO: 1989 - protein, 11 aa, Artificial
  IGFBP-2 heparin binding domain-containing peptide sequence
RKKIGLEEPKH

SEQ ID NO: 1990 - protein, 11 aa, Artificial
  IGFBP-2 heparin binding domain-containing peptide sequence
HKKIGLEEPKH

SEQ ID NO: 1991 - protein, 11 aa, Artificial
  IGFBP-2 heparin binding domain-containing peptide sequence
KRKIGLEEPKH

SEQ ID NO: 1992 - protein, 11 aa, Artificial
  IGFBP-2 heparin binding domain-containing peptide sequence
RRKIGLEEPKH

SEQ ID NO: 1993 - protein, 11 aa, Artificial
  IGFBP-2 heparin binding domain-containing peptide sequence
HRKIGLEEPKH

SEQ ID NO: 1994 - protein, 11 aa, Artificial
  IGFBP-2 heparin binding domain-containing peptide sequence
KHRIGLEEPKH

SEQ ID NO: 1995 - protein, 11 aa, Artificial
  IGFBP-2 heparin binding domain-containing peptide sequence
RHRIGLEEPKH

SEQ ID NO: 1996 - protein, 11 aa, Artificial
  IGFBP-2 heparin binding domain-containing peptide sequence
HHRIGLEEPKH

SEQ ID NO: 1997 - protein, 11 aa, Artificial
  IGFBP-2 heparin binding domain-containing peptide sequence
KKRIGLEEPKH

SEQ ID NO: 1998 - protein, 11 aa, Artificial
  IGFBP-2 heparin binding domain-containing peptide sequence
RKRIGLEEPKH

SEQ ID NO: 1999 - protein, 11 aa, Artificial
  IGFBP-2 heparin binding domain-containing peptide sequence
HKRIGLEEPKH

SEQ ID NO: 2000 - protein, 11 aa, Artificial
  IGFBP-2 heparin binding domain-containing peptide sequence
KRRIGLEEPKH

SEQ ID NO: 2001 - protein, 11 aa, Artificial
  IGFBP-2 heparin binding domain-containing peptide sequence
RRRIGLEEPKH

SEQ ID NO: 2002 - protein, 11 aa, Artificial
  IGFBP-2 heparin binding domain-containing peptide sequence
HRRIGLEEPKH

SEQ ID NO: 2003 - protein, 11 aa, Artificial
  IGFBP-2 heparin binding domain-containing peptide sequence
KHHVGLEEPKH

SEQ ID NO: 2004 - protein, 11 aa, Artificial
  IGFBP-2 heparin binding domain-containing peptide sequence
RHHVGLEEPKH

SEQ ID NO: 2005 - protein, 11 aa, Artificial
  IGFBP-2 heparin binding domain-containing peptide sequence
HHHVGLEEPKH

SEQ ID NO: 2006 - protein, 11 aa, Artificial
  IGFBP-2 heparin binding domain-containing peptide sequence
KKHVGLEEPKH

SEQ ID NO: 2007 - protein, 11 aa, Artificial
  IGFBP-2 heparin binding domain-containing peptide sequence
RKHVGLEEPKH

SEQ ID NO: 2008 - protein, 11 aa, Artificial
  IGFBP-2 heparin binding domain-containing peptide sequence
HKHVGLEEPKH

SEQ ID NO: 2009 - protein, 11 aa, Artificial
  IGFBP-2 heparin binding domain-containing peptide sequence
KRHVGLEEPKH

SEQ ID NO: 2010 - protein, 11 aa, Artificial
  IGFBP-2 heparin binding domain-containing peptide sequence
RRHVGLEEPKH

SEQ ID NO: 2011 - protein, 11 aa, Artificial
  IGFBP-2 heparin binding domain-containing peptide sequence
HRHVGLEEPKH

SEQ ID NO: 2012 - protein, 11 aa, Artificial
  IGFBP-2 heparin binding domain-containing peptide sequence
KHKVGLEEPKH

SEQ ID NO: 2013 - protein, 11 aa, Artificial
  IGFBP-2 heparin binding domain-containing peptide sequence
RHKVGLEEPKH

SEQ ID NO: 2014 - protein, 11 aa, Artificial
  IGFBP-2 heparin binding domain-containing peptide sequence
HHKVGLEEPKH

SEQ ID NO: 2015 - protein, 11 aa, Artificial
  IGFBP-2 heparin binding domain-containing peptide sequence
KKKVGLEEPKH

SEQ ID NO: 2016 - protein, 11 aa, Artificial
  IGFBP-2 heparin binding domain-containing peptide sequence
RKKVGLEEPKH

SEQ ID NO: 2017 - protein, 11 aa, Artificial
  IGFBP-2 heparin binding domain-containing peptide sequence
HKKVGLEEPKH

SEQ ID NO: 2018 - protein, 11 aa, Artificial
  IGFBP-2 heparin binding domain-containing peptide sequence
KRKVGLEEPKH

SEQ ID NO: 2019 - protein, 11 aa, Artificial
  IGFBP-2 heparin binding domain-containing peptide sequence
RRKVGLEEPKH

SEQ ID NO: 2020 - protein, 11 aa, Artificial
  IGFBP-2 heparin binding domain-containing peptide sequence
HRKVGLEEPKH

SEQ ID NO: 2021 - protein, 11 aa, Artificial
  IGFBP-2 heparin binding domain-containing peptide sequence
KHRVGLEEPKH

SEQ ID NO: 2022 - protein, 11 aa, Artificial
  IGFBP-2 heparin binding domain-containing peptide sequence
RHRVGLEEPKH

SEQ ID NO: 2023 - protein, 11 aa, Artificial
  IGFBP-2 heparin binding domain-containing peptide sequence
HHRVGLEEPKH

SEQ ID NO: 2024 - protein, 11 aa, Artificial
  IGFBP-2 heparin binding domain-containing peptide sequence
KKRVGLEEPKH

SEQ ID NO: 2025 - protein, 11 aa, Artificial
  IGFBP-2 heparin binding domain-containing peptide sequence
RKRVGLEEPKH

SEQ ID NO: 2026 - protein, 11 aa, Artificial
  IGFBP-2 heparin binding domain-containing peptide sequence
HKRVGLEEPKH

SEQ ID NO: 2027 - protein, 11 aa, Artificial
  IGFBP-2 heparin binding domain-containing peptide sequence
KRRVGLEEPKH

SEQ ID NO: 2028 - protein, 11 aa, Artificial
  IGFBP-2 heparin binding domain-containing peptide sequence
RRRVGLEEPKH

SEQ ID NO: 2029 - protein, 11 aa, Artificial
  IGFBP-2 heparin binding domain-containing peptide sequence
HRRVGLEEPKH

SEQ ID NO: 2030 - protein, 11 aa, Artificial
  IGFBP-2 heparin binding domain-containing peptide sequence
KHHLGIEEPKH

SEQ ID NO: 2031 - protein, 11 aa, Artificial
  IGFBP-2 heparin binding domain-containing peptide sequence
RHHLGIEEPKH

SEQ ID NO: 2032 - protein, 11 aa, Artificial
  IGFBP-2 heparin binding domain-containing peptide sequence
HHHLGIEEPKH

SEQ ID NO: 2033 - protein, 11 aa, Artificial
  IGFBP-2 heparin binding domain-containing peptide sequence
KKHLGIEEPKH

SEQ ID NO: 2034 - protein, 11 aa, Artificial
  IGFBP-2 heparin binding domain-containing peptide sequence
RKHLGIEEPKH

SEQ ID NO: 2035 - protein, 11 aa, Artificial
  IGFBP-2 heparin binding domain-containing peptide sequence
HKHLGIEEPKH

SEQ ID NO: 2036 - protein, 11 aa, Artificial
  IGFBP-2 heparin binding domain-containing peptide sequence
KRHLGIEEPKH

SEQ ID NO: 2037 - protein, 11 aa, Artificial
  IGFBP-2 heparin binding domain-containing peptide sequence
RRHLGIEEPKH

SEQ ID NO: 2038 - protein, 11 aa, Artificial
  IGFBP-2 heparin binding domain-containing peptide sequence
HRHLGIEEPKH

SEQ ID NO: 2039 - protein, 11 aa, Artificial
  IGFBP-2 heparin binding domain-containing peptide sequence
KHKLGIEEPKH

SEQ ID NO: 2040 - protein, 11 aa, Artificial
  IGFBP-2 heparin binding domain-containing peptide sequence
RHKLGIEEPKH

SEQ ID NO: 2041 - protein, 11 aa, Artificial
  IGFBP-2 heparin binding domain-containing peptide sequence
HHKLGIEEPKH

SEQ ID NO: 2042 - protein, 11 aa, Artificial
  IGFBP-2 heparin binding domain-containing peptide sequence
KKKLGIEEPKH

SEQ ID NO: 2043 - protein, 11 aa, Artificial
  IGFBP-2 heparin binding domain-containing peptide sequence
RKKLGIEEPKH

SEQ ID NO: 2044 - protein, 11 aa, Artificial
  IGFBP-2 heparin binding domain-containing peptide sequence
HKKLGIEEPKH

SEQ ID NO: 2045 - protein, 11 aa, Artificial
  IGFBP-2 heparin binding domain-containing peptide sequence
KRKLGIEEPKH

SEQ ID NO: 2046 - protein, 11 aa, Artificial
  IGFBP-2 heparin binding domain-containing peptide sequence
RRKLGIEEPKH

SEQ ID NO: 2047 - protein, 11 aa, Artificial
  IGFBP-2 heparin binding domain-containing peptide sequence
HRKLGIEEPKH

SEQ ID NO: 2048 - protein, 11 aa, Artificial
  IGFBP-2 heparin binding domain-containing peptide sequence
KHRLGIEEPKH

SEQ ID NO: 2049 - protein, 11 aa, Artificial
  IGFBP-2 heparin binding domain-containing peptide sequence
RHRLGIEEPKH

SEQ ID NO: 2050 - protein, 11 aa, Artificial
  IGFBP-2 heparin binding domain-containing peptide sequence
HHRLGIEEPKH

SEQ ID NO: 2051 - protein, 11 aa, Artificial
  IGFBP-2 heparin binding domain-containing peptide sequence
KKRLGIEEPKH

SEQ ID NO: 2052 - protein, 11 aa, Artificial
  IGFBP-2 heparin binding domain-containing peptide sequence
RKRLGIEEPKH

SEQ ID NO: 2053 - protein, 11 aa, Artificial
  IGFBP-2 heparin binding domain-containing peptide sequence
HKRLGIEEPKH

SEQ ID NO: 2054 - protein, 11 aa, Artificial
  IGFBP-2 heparin binding domain-containing peptide sequence
KRRLGIEEPKH

SEQ ID NO: 2055 - protein, 11 aa, Artificial
  IGFBP-2 heparin binding domain-containing peptide sequence
RRRLGIEEPKH

SEQ ID NO: 2056 - protein, 11 aa, Artificial
  IGFBP-2 heparin binding domain-containing peptide sequence
HRRLGIEEPKH

SEQ ID NO: 2057 - protein, 11 aa, Artificial
  IGFBP-2 heparin binding domain-containing peptide sequence
KHHIGIEEPKH

SEQ ID NO: 2058 - protein, 11 aa, Artificial
  IGFBP-2 heparin binding domain-containing peptide sequence
RHHIGIEEPKH

SEQ ID NO: 2059 - protein, 11 aa, Artificial
  IGFBP-2 heparin binding domain-containing peptide sequence
HHHIGIEEPKH

SEQ ID NO: 2060 - protein, 11 aa, Artificial
  IGFBP-2 heparin binding domain-containing peptide sequence
KKHIGIEEPKH

SEQ ID NO: 2061 - protein, 11 aa, Artificial
  IGFBP-2 heparin binding domain-containing peptide sequence
RKHIGIEEPKH

SEQ ID NO: 2062 - protein, 11 aa, Artificial
  IGFBP-2 heparin binding domain-containing peptide sequence
HKHIGIEEPKH

SEQ ID NO: 2063 - protein, 11 aa, Artificial
  IGFBP-2 heparin binding domain-containing peptide sequence
KRHIGIEEPKH

SEQ ID NO: 2064 - protein, 11 aa, Artificial
  IGFBP-2 heparin binding domain-containing peptide sequence
RRHIGIEEPKH

SEQ ID NO: 2065 - protein, 11 aa, Artificial
  IGFBP-2 heparin binding domain-containing peptide sequence
HRHIGIEEPKH

SEQ ID NO: 2066 - protein, 11 aa, Artificial
  IGFBP-2 heparin binding domain-containing peptide sequence
KHKIGIEEPKH

SEQ ID NO: 2067 - protein, 11 aa, Artificial
  IGFBP-2 heparin binding domain-containing peptide sequence
RHKIGIEEPKH

SEQ ID NO: 2068 - protein, 11 aa, Artificial
  IGFBP-2 heparin binding domain-containing peptide sequence
HHKIGIEEPKH

SEQ ID NO: 2069 - protein, 11 aa, Artificial
  IGFBP-2 heparin binding domain-containing peptide sequence
KKKIGIEEPKH

SEQ ID NO: 2070 - protein, 11 aa, Artificial
  IGFBP-2 heparin binding domain-containing peptide sequence
RKKIGIEEPKH

SEQ ID NO: 2071 - protein, 11 aa, Artificial
  IGFBP-2 heparin binding domain-containing peptide sequence
HKKIGIEEPKH

SEQ ID NO: 2072 - protein, 11 aa, Artificial
  IGFBP-2 heparin binding domain-containing peptide sequence
KRKIGIEEPKH

SEQ ID NO: 2073 - protein, 11 aa, Artificial
  IGFBP-2 heparin binding domain-containing peptide sequence
RRKIGIEEPKH

SEQ ID NO: 2074 - protein, 11 aa, Artificial
  IGFBP-2 heparin binding domain-containing peptide sequence
HRKIGIEEPKH

SEQ ID NO: 2075 - protein, 11 aa, Artificial
  IGFBP-2 heparin binding domain-containing peptide sequence
KHRIGIEEPKH

SEQ ID NO: 2076 - protein, 11 aa, Artificial
  IGFBP-2 heparin binding domain-containing peptide sequence
RHRIGIEEPKH

SEQ ID NO: 2077 - protein, 11 aa, Artificial
  IGFBP-2 heparin binding domain-containing peptide sequence
HHRIGIEEPKH

SEQ ID NO: 2078 - protein, 11 aa, Artificial
  IGFBP-2 heparin binding domain-containing peptide sequence
KKRIGIEEPKH

SEQ ID NO: 2079 - protein, 11 aa, Artificial
  IGFBP-2 heparin binding domain-containing peptide sequence
RKRIGIEEPKH

SEQ ID NO: 2080 - protein, 11 aa, Artificial
  IGFBP-2 heparin binding domain-containing peptide sequence
HKRIGIEEPKH

SEQ ID NO: 2081 - protein, 11 aa, Artificial
  IGFBP-2 heparin binding domain-containing peptide sequence
KRRIGIEEPKH

SEQ ID NO: 2082 - protein, 11 aa, Artificial
  IGFBP-2 heparin binding domain-containing peptide sequence
RRRIGIEEPKH

SEQ ID NO: 2083 - protein, 11 aa, Artificial
  IGFBP-2 heparin binding domain-containing peptide sequence
HRRIGIEEPKH

SEQ ID NO: 2084 - protein, 11 aa, Artificial
  IGFBP-2 heparin binding domain-containing peptide sequence
KHHVGIEEPKH

SEQ ID NO: 2085 - protein, 11 aa, Artificial
  IGFBP-2 heparin binding domain-containing peptide sequence
RHHVGIEEPKH

SEQ ID NO: 2086 - protein, 11 aa, Artificial
  IGFBP-2 heparin binding domain-containing peptide sequence
HHHVGIEEPKH

SEQ ID NO: 2087 - protein, 11 aa, Artificial
  IGFBP-2 heparin binding domain-containing peptide sequence
KKHVGIEEPKH

SEQ ID NO: 2088 - protein, 11 aa, Artificial
  IGFBP-2 heparin binding domain-containing peptide sequence
RKHVGIEEPKH

SEQ ID NO: 2089 - protein, 11 aa, Artificial
  IGFBP-2 heparin binding domain-containing peptide sequence
HKHVGIEEPKH

SEQ ID NO: 2090 - protein, 11 aa, Artificial
  IGFBP-2 heparin binding domain-containing peptide sequence
KRHVGIEEPKH

SEQ ID NO: 2091 - protein, 11 aa, Artificial
  IGFBP-2 heparin binding domain-containing peptide sequence
RRHVGIEEPKH

SEQ ID NO: 2092 - protein, 11 aa, Artificial
  IGFBP-2 heparin binding domain-containing peptide sequence
HRHVGIEEPKH

SEQ ID NO: 2093 - protein, 11 aa, Artificial
  IGFBP-2 heparin binding domain-containing peptide sequence
KHKVGIEEPKH

SEQ ID NO: 2094 - protein, 11 aa, Artificial
  IGFBP-2 heparin binding domain-containing peptide sequence
RHKVGIEEPKH

SEQ ID NO: 2095 - protein, 11 aa, Artificial
  IGFBP-2 heparin binding domain-containing peptide sequence
HHKVGIEEPKH

SEQ ID NO: 2096 - protein, 11 aa, Artificial
  IGFBP-2 heparin binding domain-containing peptide sequence
KKKVGIEEPKH

SEQ ID NO: 2097 - protein, 11 aa, Artificial
  IGFBP-2 heparin binding domain-containing peptide sequence
RKKVGIEEPKH

SEQ ID NO: 2098 - protein, 11 aa, Artificial
  IGFBP-2 heparin binding domain-containing peptide sequence
HKKVGIEEPKH

SEQ ID NO: 2099 - protein, 11 aa, Artificial
  IGFBP-2 heparin binding domain-containing peptide sequence
KRKVGIEEPKH

SEQ ID NO: 2100 - protein, 11 aa, Artificial
  IGFBP-2 heparin binding domain-containing peptide sequence
RRKVGIEEPKH

SEQ ID NO: 2101 - protein, 11 aa, Artificial
  IGFBP-2 heparin binding domain-containing peptide sequence
HRKVGIEEPKH

SEQ ID NO: 2102 - protein, 11 aa, Artificial
  IGFBP-2 heparin binding domain-containing peptide sequence
KHRVGIEEPKH

SEQ ID NO: 2103 - protein, 11 aa, Artificial
  IGFBP-2 heparin binding domain-containing peptide sequence
RHRVGIEEPKH

SEQ ID NO: 2104 - protein, 11 aa, Artificial
  IGFBP-2 heparin binding domain-containing peptide sequence
HHRVGIEEPKH

SEQ ID NO: 2105 - protein, 11 aa, Artificial
  IGFBP-2 heparin binding domain-containing peptide sequence
KKRVGIEEPKH

SEQ ID NO: 2106 - protein, 11 aa, Artificial
  IGFBP-2 heparin binding domain-containing peptide sequence
RKRVGIEEPKH

SEQ ID NO: 2107 - protein, 11 aa, Artificial
  IGFBP-2 heparin binding domain-containing peptide sequence
HKRVGIEEPKH

SEQ ID NO: 2108 - protein, 11 aa, Artificial
  IGFBP-2 heparin binding domain-containing peptide sequence
KRRVGIEEPKH

SEQ ID NO: 2109 - protein, 11 aa, Artificial
  IGFBP-2 heparin binding domain-containing peptide sequence
RRRVGIEEPKH

SEQ ID NO: 2110 - protein, 11 aa, Artificial
  IGFBP-2 heparin binding domain-containing peptide sequence
HRRVGIEEPKH

SEQ ID NO: 2111 - protein, 11 aa, Artificial
  IGFBP-2 heparin binding domain-containing peptide sequence
KHHLGVEEPKH

SEQ ID NO: 2112 - protein, 11 aa, Artificial
  IGFBP-2 heparin binding domain-containing peptide sequence
RHHLGVEEPKH

SEQ ID NO: 2113 - protein, 11 aa, Artificial
  IGFBP-2 heparin binding domain-containing peptide sequence
HHHLGVEEPKH

SEQ ID NO: 2114 - protein, 11 aa, Artificial
  IGFBP-2 heparin binding domain-containing peptide sequence
KKHLGVEEPKH

SEQ ID NO: 2115 - protein, 11 aa, Artificial
  IGFBP-2 heparin binding domain-containing peptide sequence
RKHLGVEEPKH

SEQ ID NO: 2116 - protein, 11 aa, Artificial
  IGFBP-2 heparin binding domain-containing peptide sequence
HKHLGVEEPKH

SEQ ID NO: 2117 - protein, 11 aa, Artificial
  IGFBP-2 heparin binding domain-containing peptide sequence
KRHLGVEEPKH

SEQ ID NO: 2118 - protein, 11 aa, Artificial
  IGFBP-2 heparin binding domain-containing peptide sequence
RRHLGVEEPKH

SEQ ID NO: 2119 - protein, 11 aa, Artificial
  IGFBP-2 heparin binding domain-containing peptide sequence
HRHLGVEEPKH

SEQ ID NO: 2120 - protein, 11 aa, Artificial
  IGFBP-2 heparin binding domain-containing peptide sequence
KHKLGVEEPKH

SEQ ID NO: 2121 - protein, 11 aa, Artificial
  IGFBP-2 heparin binding domain-containing peptide sequence
RHKLGVEEPKH

SEQ ID NO: 2122 - protein, 11 aa, Artificial
  IGFBP-2 heparin binding domain-containing peptide sequence
HHKLGVEEPKH

SEQ ID NO: 2123 - protein, 11 aa, Artificial
  IGFBP-2 heparin binding domain-containing peptide sequence
KKKLGVEEPKH

SEQ ID NO: 2124 - protein, 11 aa, Artificial
  IGFBP-2 heparin binding domain-containing peptide sequence
RKKLGVEEPKH

SEQ ID NO: 2125 - protein, 11 aa, Artificial
  IGFBP-2 heparin binding domain-containing peptide sequence
HKKLGVEEPKH

SEQ ID NO: 2126 - protein, 11 aa, Artificial
  IGFBP-2 heparin binding domain-containing peptide sequence
KRKLGVEEPKH

SEQ ID NO: 2127 - protein, 11 aa, Artificial
  IGFBP-2 heparin binding domain-containing peptide sequence
RRKLGVEEPKH

SEQ ID NO: 2128 - protein, 11 aa, Artificial
  IGFBP-2 heparin binding domain-containing peptide sequence
HRKLGVEEPKH

SEQ ID NO: 2129 - protein, 11 aa, Artificial
  IGFBP-2 heparin binding domain-containing peptide sequence
KHRLGVEEPKH

SEQ ID NO: 2130 - protein, 11 aa, Artificial
  IGFBP-2 heparin binding domain-containing peptide sequence
RHRLGVEEPKH

SEQ ID NO: 2131 - protein, 11 aa, Artificial
  IGFBP-2 heparin binding domain-containing peptide sequence
HHRLGVEEPKH

SEQ ID NO: 2132 - protein, 11 aa, Artificial
  IGFBP-2 heparin binding domain-containing peptide sequence
KKRLGVEEPKH

SEQ ID NO: 2133 - protein, 11 aa, Artificial
  IGFBP-2 heparin binding domain-containing peptide sequence
RKRLGVEEPKH

SEQ ID NO: 2134 - protein, 11 aa, Artificial
  IGFBP-2 heparin binding domain-containing peptide sequence
HKRLGVEEPKH

SEQ ID NO: 2135 - protein, 11 aa, Artificial
  IGFBP-2 heparin binding domain-containing peptide sequence
KRRLGVEEPKH

SEQ ID NO: 2136 - protein, 11 aa, Artificial
  IGFBP-2 heparin binding domain-containing peptide sequence
RRRLGVEEPKH

SEQ ID NO: 2137 - protein, 11 aa, Artificial
  IGFBP-2 heparin binding domain-containing peptide sequence
HRRLGVEEPKH

SEQ ID NO: 2138 - protein, 11 aa, Artificial
  IGFBP-2 heparin binding domain-containing peptide sequence
KHHIGVEEPKH

SEQ ID NO: 2139 - protein, 11 aa, Artificial
  IGFBP-2 heparin binding domain-containing peptide sequence
RHHIGVEEPKH

SEQ ID NO: 2140 - protein, 11 aa, Artificial
  IGFBP-2 heparin binding domain-containing peptide sequence
HHHIGVEEPKH

SEQ ID NO: 2141 - protein, 11 aa, Artificial
  IGFBP-2 heparin binding domain-containing peptide sequence
KKHIGVEEPKH

SEQ ID NO: 2142 - protein, 11 aa, Artificial
  IGFBP-2 heparin binding domain-containing peptide sequence
RKHIGVEEPKH

SEQ ID NO: 2143 - protein, 11 aa, Artificial
  IGFBP-2 heparin binding domain-containing peptide sequence
HKHIGVEEPKH

SEQ ID NO: 2144 - protein, 11 aa, Artificial
  IGFBP-2 heparin binding domain-containing peptide sequence
KRHIGVEEPKH

SEQ ID NO: 2145 - protein, 11 aa, Artificial
  IGFBP-2 heparin binding domain-containing peptide sequence
RRHIGVEEPKH

SEQ ID NO: 2146 - protein, 11 aa, Artificial
  IGFBP-2 heparin binding domain-containing peptide sequence
HRHIGVEEPKH

SEQ ID NO: 2147 - protein, 11 aa, Artificial
  IGFBP-2 heparin binding domain-containing peptide sequence
KHKIGVEEPKH

SEQ ID NO: 2148 - protein, 11 aa, Artificial
  IGFBP-2 heparin binding domain-containing peptide sequence
RHKIGVEEPKH

SEQ ID NO: 2149 - protein, 11 aa, Artificial
  IGFBP-2 heparin binding domain-containing peptide sequence
HHKIGVEEPKH

SEQ ID NO: 2150 - protein, 11 aa, Artificial
  IGFBP-2 heparin binding domain-containing peptide sequence
KKKIGVEEPKH

SEQ ID NO: 2151 - protein, 11 aa, Artificial
  IGFBP-2 heparin binding domain-containing peptide sequence
RKKIGVEEPKH

SEQ ID NO: 2152 - protein, 11 aa, Artificial
  IGFBP-2 heparin binding domain-containing peptide sequence
HKKIGVEEPKH

SEQ ID NO: 2153 - protein, 11 aa, Artificial
  IGFBP-2 heparin binding domain-containing peptide sequence
KRKIGVEEPKH

SEQ ID NO: 2154 - protein, 11 aa, Artificial
  IGFBP-2 heparin binding domain-containing peptide sequence
RRKIGVEEPKH

SEQ ID NO: 2155 - protein, 11 aa, Artificial
  IGFBP-2 heparin binding domain-containing peptide sequence
HRKIGVEEPKH

SEQ ID NO: 2156 - protein, 11 aa, Artificial
  IGFBP-2 heparin binding domain-containing peptide sequence
KHRIGVEEPKH

SEQ ID NO: 2157 - protein, 11 aa, Artificial
  IGFBP-2 heparin binding domain-containing peptide sequence
RHRIGVEEPKH

SEQ ID NO: 2158 - protein, 11 aa, Artificial
  IGFBP-2 heparin binding domain-containing peptide sequence
HHRIGVEEPKH

SEQ ID NO: 2159 - protein, 11 aa, Artificial
  IGFBP-2 heparin binding domain-containing peptide sequence
KKRIGVEEPKH

SEQ ID NO: 2160 - protein, 11 aa, Artificial
  IGFBP-2 heparin binding domain-containing peptide sequence
RKRIGVEEPKH

SEQ ID NO: 2161 - protein, 11 aa, Artificial
  IGFBP-2 heparin binding domain-containing peptide sequence
HKRIGVEEPKH

SEQ ID NO: 2162 - protein, 11 aa, Artificial
  IGFBP-2 heparin binding domain-containing peptide sequence
KRRIGVEEPKH

SEQ ID NO: 2163 - protein, 11 aa, Artificial
  IGFBP-2 heparin binding domain-containing peptide sequence
RRRIGVEEPKH

SEQ ID NO: 2164 - protein, 11 aa, Artificial
  IGFBP-2 heparin binding domain-containing peptide sequence
HRRIGVEEPKH

SEQ ID NO: 2165 - protein, 11 aa, Artificial
  IGFBP-2 heparin binding domain-containing peptide sequence
KHHVGVEEPKH

SEQ ID NO: 2166 - protein, 11 aa, Artificial
  IGFBP-2 heparin binding domain-containing peptide sequence
RHHVGVEEPKH

SEQ ID NO: 2167 - protein, 11 aa, Artificial
  IGFBP-2 heparin binding domain-containing peptide sequence
HHHVGVEEPKH

SEQ ID NO: 2168 - protein, 11 aa, Artificial
  IGFBP-2 heparin binding domain-containing peptide sequence
KKHVGVEEPKH

SEQ ID NO: 2169 - protein, 11 aa, Artificial
  IGFBP-2 heparin binding domain-containing peptide sequence
RKHVGVEEPKH

SEQ ID NO: 2170 - protein, 11 aa, Artificial
  IGFBP-2 heparin binding domain-containing peptide sequence
HKHVGVEEPKH

SEQ ID NO: 2171 - protein, 11 aa, Artificial
  IGFBP-2 heparin binding domain-containing peptide sequence
KRHVGVEEPKH

SEQ ID NO: 2172 - protein, 11 aa, Artificial
  IGFBP-2 heparin binding domain-containing peptide sequence
RRHVGVEEPKH

SEQ ID NO: 2173 - protein, 11 aa, Artificial
  IGFBP-2 heparin binding domain-containing peptide sequence
HRHVGVEEPKH

SEQ ID NO: 2174 - protein, 11 aa, Artificial
  IGFBP-2 heparin binding domain-containing peptide sequence
KHKVGVEEPKH

SEQ ID NO: 2175 - protein, 11 aa, Artificial
  IGFBP-2 heparin binding domain-containing peptide sequence
RHKVGVEEPKH

SEQ ID NO: 2176 - protein, 11 aa, Artificial
  IGFBP-2 heparin binding domain-containing peptide sequence
HHKVGVEEPKH

SEQ ID NO: 2177 - protein, 11 aa, Artificial
  IGFBP-2 heparin binding domain-containing peptide sequence
KKKVGVEEPKH

SEQ ID NO: 2178 - protein, 11 aa, Artificial
  IGFBP-2 heparin binding domain-containing peptide sequence
RKKVGVEEPKH

SEQ ID NO: 2179 - protein, 11 aa, Artificial
  IGFBP-2 heparin binding domain-containing peptide sequence
HKKVGVEEPKH

SEQ ID NO: 2180 - protein, 11 aa, Artificial
  IGFBP-2 heparin binding domain-containing peptide sequence
KRKVGVEEPKH

SEQ ID NO: 2181 - protein, 11 aa, Artificial
  IGFBP-2 heparin binding domain-containing peptide sequence
RRKVGVEEPKH

SEQ ID NO: 2182 - protein, 11 aa, Artificial
  IGFBP-2 heparin binding domain-containing peptide sequence
HRKVGVEEPKH

SEQ ID NO: 2183 - protein, 11 aa, Artificial
  IGFBP-2 heparin binding domain-containing peptide sequence
KHRVGVEEPKH

SEQ ID NO: 2184 - protein, 11 aa, Artificial
  IGFBP-2 heparin binding domain-containing peptide sequence
RHRVGVEEPKH

SEQ ID NO: 2185 - protein, 11 aa, Artificial
  IGFBP-2 heparin binding domain-containing peptide sequence
HHRVGVEEPKH

SEQ ID NO: 2186 - protein, 11 aa, Artificial
  IGFBP-2 heparin binding domain-containing peptide sequence
KKRVGVEEPKH

SEQ ID NO: 2187 - protein, 11 aa, Artificial
  IGFBP-2 heparin binding domain-containing peptide sequence
RKRVGVEEPKH

SEQ ID NO: 2188 - protein, 11 aa, Artificial
  IGFBP-2 heparin binding domain-containing peptide sequence
HKRVGVEEPKH

SEQ ID NO: 2189 - protein, 11 aa, Artificial
  IGFBP-2 heparin binding domain-containing peptide sequence
KRRVGVEEPKH

SEQ ID NO: 2190 - protein, 11 aa, Artificial
  IGFBP-2 heparin binding domain-containing peptide sequence
RRRVGVEEPKH

SEQ ID NO: 2191 - protein, 11 aa, Artificial
  IGFBP-2 heparin binding domain-containing peptide sequence
HRRVGVEEPKH

SEQ ID NO: 2192 - protein, 11 aa, Artificial
  IGFBP-2 heparin binding domain-containing peptide sequence
KHHLGLNEPKH

SEQ ID NO: 2193 - protein, 11 aa, Artificial
  IGFBP-2 heparin binding domain-containing peptide sequence
RHHLGLNEPKH

SEQ ID NO: 2194 - protein, 11 aa, Artificial
  IGFBP-2 heparin binding domain-containing peptide sequence
HHHLGLNEPKH

SEQ ID NO: 2195 - protein, 11 aa, Artificial
  IGFBP-2 heparin binding domain-containing peptide sequence
KKHLGLNEPKH

SEQ ID NO: 2196 - protein, 11 aa, Artificial
  IGFBP-2 heparin binding domain-containing peptide sequence
RKHLGLNEPKH

SEQ ID NO: 2197 - protein, 11 aa, Artificial
  IGFBP-2 heparin binding domain-containing peptide sequence
HKHLGLNEPKH

SEQ ID NO: 2198 - protein, 11 aa, Artificial
  IGFBP-2 heparin binding domain-containing peptide sequence
KRHLGLNEPKH

SEQ ID NO: 2199 - protein, 11 aa, Artificial
  IGFBP-2 heparin binding domain-containing peptide sequence
RRHLGLNEPKH

SEQ ID NO: 2200 - protein, 11 aa, Artificial
  IGFBP-2 heparin binding domain-containing peptide sequence
HRHLGLNEPKH

SEQ ID NO: 2201 - protein, 11 aa, Artificial
  IGFBP-2 heparin binding domain-containing peptide sequence
KHKLGLNEPKH

SEQ ID NO: 2202 - protein, 11 aa, Artificial
  IGFBP-2 heparin binding domain-containing peptide sequence
RHKLGLNEPKH

SEQ ID NO: 2203 - protein, 11 aa, Artificial
  IGFBP-2 heparin binding domain-containing peptide sequence
HHKLGLNEPKH

SEQ ID NO: 2204 - protein, 11 aa, Artificial
  IGFBP-2 heparin binding domain-containing peptide sequence
KKKLGLNEPKH

SEQ ID NO: 2205 - protein, 11 aa, Artificial
  IGFBP-2 heparin binding domain-containing peptide sequence
RKKLGLNEPKH

SEQ ID NO: 2206 - protein, 11 aa, Artificial
  IGFBP-2 heparin binding domain-containing peptide sequence
HKKLGLNEPKH

SEQ ID NO: 2207 - protein, 11 aa, Artificial
  IGFBP-2 heparin binding domain-containing peptide sequence
KRKLGLNEPKH

SEQ ID NO: 2208 - protein, 11 aa, Artificial
  IGFBP-2 heparin binding domain-containing peptide sequence
RRKLGLNEPKH

SEQ ID NO: 2209 - protein, 11 aa, Artificial
  IGFBP-2 heparin binding domain-containing peptide sequence
HRKLGLNEPKH

SEQ ID NO: 2210 - protein, 11 aa, Artificial
  IGFBP-2 heparin binding domain-containing peptide sequence
KHRLGLNEPKH

SEQ ID NO: 2211 - protein, 11 aa, Artificial
  IGFBP-2 heparin binding domain-containing peptide sequence
RHRLGLNEPKH

SEQ ID NO: 2212 - protein, 11 aa, Artificial
  IGFBP-2 heparin binding domain-containing peptide sequence
HHRLGLNEPKH

SEQ ID NO: 2213 - protein, 11 aa, Artificial
  IGFBP-2 heparin binding domain-containing peptide sequence
KKRLGLNEPKH

SEQ ID NO: 2214 - protein, 11 aa, Artificial
  IGFBP-2 heparin binding domain-containing peptide sequence
RKRLGLNEPKH

SEQ ID NO: 2215 - protein, 11 aa, Artificial
  IGFBP-2 heparin binding domain-containing peptide sequence
HKRLGLNEPKH

SEQ ID NO: 2216 - protein, 11 aa, Artificial
  IGFBP-2 heparin binding domain-containing peptide sequence
KRRLGLNEPKH

SEQ ID NO: 2217 - protein, 11 aa, Artificial
  IGFBP-2 heparin binding domain-containing peptide sequence
RRRLGLNEPKH

SEQ ID NO: 2218 - protein, 11 aa, Artificial
  IGFBP-2 heparin binding domain-containing peptide sequence
HRRLGLNEPKH

SEQ ID NO: 2219 - protein, 10 aa, Artificial
  IGFBP-2 heparin binding domain-containing peptide sequence
KHHIGLNPKH

SEQ ID NO: 2220 - protein, 11 aa, Artificial
  IGFBP-2 heparin binding domain-containing peptide sequence
RHHIGLNEPKH

SEQ ID NO: 2221 - protein, 11 aa, Artificial
  IGFBP-2 heparin binding domain-containing peptide sequence
HHHIGLNEPKH

SEQ ID NO: 2222 - protein, 11 aa, Artificial
  IGFBP-2 heparin binding domain-containing peptide sequence
KKHIGLNEPKH

SEQ ID NO: 2223 - protein, 11 aa, Artificial
  IGFBP-2 heparin binding domain-containing peptide sequence
RKHIGLNEPKH

SEQ ID NO: 2224 - protein, 11 aa, Artificial
  IGFBP-2 heparin binding domain-containing peptide sequence
HKHIGLNEPKH

SEQ ID NO: 2225 - protein, 11 aa, Artificial
  IGFBP-2 heparin binding domain-containing peptide sequence
KRHIGLNEPKH

SEQ ID NO: 2226 - protein, 11 aa, Artificial
  IGFBP-2 heparin binding domain-containing peptide sequence
RRHIGLNEPKH

SEQ ID NO: 2227 - protein, 11 aa, Artificial
  IGFBP-2 heparin binding domain-containing peptide sequence
HRHIGLNEPKH

SEQ ID NO: 2228 - protein, 11 aa, Artificial
  IGFBP-2 heparin binding domain-containing peptide sequence
KHKIGLNEPKH

SEQ ID NO: 2229 - protein, 11 aa, Artificial
  IGFBP-2 heparin binding domain-containing peptide sequence
RHKIGLNEPKH

SEQ ID NO: 2230 - protein, 11 aa, Artificial
  IGFBP-2 heparin binding domain-containing peptide sequence
HHKIGLNEPKH

SEQ ID NO: 2231 - protein, 11 aa, Artificial
  IGFBP-2 heparin binding domain-containing peptide sequence
KKKIGLNEPKH

SEQ ID NO: 2232 - protein, 11 aa, Artificial
  IGFBP-2 heparin binding domain-containing peptide sequence
RKKIGLNEPKH

SEQ ID NO: 2233 - protein, 11 aa, Artificial
  IGFBP-2 heparin binding domain-containing peptide sequence
HKKIGLNEPKH

SEQ ID NO: 2234 - protein, 11 aa, Artificial
  IGFBP-2 heparin binding domain-containing peptide sequence
KRKIGLNEPKH

SEQ ID NO: 2235 - protein, 11 aa, Artificial
  IGFBP-2 heparin binding domain-containing peptide sequence
RRKIGLNEPKH

SEQ ID NO: 2236 - protein, 11 aa, Artificial
  IGFBP-2 heparin binding domain-containing peptide sequence
HRKIGLNEPKH

SEQ ID NO: 2237 - protein, 11 aa, Artificial
  IGFBP-2 heparin binding domain-containing peptide sequence
KHRIGLNEPKH

SEQ ID NO: 2238 - protein, 11 aa, Artificial
  IGFBP-2 heparin binding domain-containing peptide sequence
RHRIGLNEPKH

SEQ ID NO: 2239 - protein, 11 aa, Artificial
  IGFBP-2 heparin binding domain-containing peptide sequence
HHRIGLNEPKH

SEQ ID NO: 2240 - protein, 11 aa, Artificial
  IGFBP-2 heparin binding domain-containing peptide sequence
KKRIGLNEPKH

SEQ ID NO: 2241 - protein, 11 aa, Artificial
  IGFBP-2 heparin binding domain-containing peptide sequence
RKRIGLNEPKH

SEQ ID NO: 2242 - protein, 11 aa, Artificial
  IGFBP-2 heparin binding domain-containing peptide sequence
HKRIGLNEPKH

SEQ ID NO: 2243 - protein, 11 aa, Artificial
  IGFBP-2 heparin binding domain-containing peptide sequence
KRRIGLNEPKH

SEQ ID NO: 2244 - protein, 11 aa, Artificial
  IGFBP-2 heparin binding domain-containing peptide sequence
RRRIGLNEPKH

SEQ ID NO: 2245 - protein, 11 aa, Artificial
  IGFBP-2 heparin binding domain-containing peptide sequence
HRRIGLNEPKH

SEQ ID NO: 2246 - protein, 11 aa, Artificial
  IGFBP-2 heparin binding domain-containing peptide sequence
KHHVGLNEPKH

SEQ ID NO: 2247 - protein, 11 aa, Artificial
  IGFBP-2 heparin binding domain-containing peptide sequence
RHHVGLNEPKH

SEQ ID NO: 2248 - protein, 11 aa, Artificial
  IGFBP-2 heparin binding domain-containing peptide sequence
HHHVGLNEPKH

SEQ ID NO: 2249 - protein, 11 aa, Artificial
  IGFBP-2 heparin binding domain-containing peptide sequence
KKHVGLNEPKH

SEQ ID NO: 2250 - protein, 11 aa, Artificial
  IGFBP-2 heparin binding domain-containing peptide sequence
RKHVGLNEPKH

SEQ ID NO: 2251 - protein, 11 aa, Artificial
  IGFBP-2 heparin binding domain-containing peptide sequence
HKHVGLNEPKH

SEQ ID NO: 2252 - protein, 11 aa, Artificial
  IGFBP-2 heparin binding domain-containing peptide sequence
KRHVGLNEPKH

SEQ ID NO: 2253 - protein, 11 aa, Artificial
  IGFBP-2 heparin binding domain-containing peptide sequence
RRHVGLNEPKH

SEQ ID NO: 2254 - protein, 11 aa, Artificial
  IGFBP-2 heparin binding domain-containing peptide sequence
HRHVGLNEPKH

SEQ ID NO: 2255 - protein, 11 aa, Artificial
  IGFBP-2 heparin binding domain-containing peptide sequence
KHKVGLNEPKH

SEQ ID NO: 2256 - protein, 11 aa, Artificial
  IGFBP-2 heparin binding domain-containing peptide sequence
RHKVGLNEPKH

SEQ ID NO: 2257 - protein, 11 aa, Artificial
  IGFBP-2 heparin binding domain-containing peptide sequence
HHKVGLNEPKH

SEQ ID NO: 2258 - protein, 11 aa, Artificial
  IGFBP-2 heparin binding domain-containing peptide sequence
KKKVGLNEPKH

SEQ ID NO: 2259 - protein, 11 aa, Artificial
  IGFBP-2 heparin binding domain-containing peptide sequence
RKKVGLNEPKH

SEQ ID NO: 2260 - protein, 11 aa, Artificial
  IGFBP-2 heparin binding domain-containing peptide sequence
HKKVGLNEPKH

SEQ ID NO: 2261 - protein, 11 aa, Artificial
  IGFBP-2 heparin binding domain-containing peptide sequence
KRKVGLNEPKH

SEQ ID NO: 2262 - protein, 11 aa, Artificial
  IGFBP-2 heparin binding domain-containing peptide sequence
RRKVGLNEPKH

SEQ ID NO: 2263 - protein, 11 aa, Artificial
  IGFBP-2 heparin binding domain-containing peptide sequence
HRKVGLNEPKH

SEQ ID NO: 2264 - protein, 11 aa, Artificial
  IGFBP-2 heparin binding domain-containing peptide sequence
KHRVGLNEPKH

SEQ ID NO: 2265 - protein, 11 aa, Artificial
  IGFBP-2 heparin binding domain-containing peptide sequence
RHRVGLNEPKH

SEQ ID NO: 2266 - protein, 11 aa, Artificial
  IGFBP-2 heparin binding domain-containing peptide sequence
HHRVGLNEPKH

SEQ ID NO: 2267 - protein, 11 aa, Artificial
  IGFBP-2 heparin binding domain-containing peptide sequence
KKRVGLNEPKH

SEQ ID NO: 2268 - protein, 11 aa, Artificial
  IGFBP-2 heparin binding domain-containing peptide sequence
RKRVGLNEPKH

SEQ ID NO: 2269 - protein, 11 aa, Artificial
  IGFBP-2 heparin binding domain-containing peptide sequence
HKRVGLNEPKH

SEQ ID NO: 2270 - protein, 11 aa, Artificial
  IGFBP-2 heparin binding domain-containing peptide sequence
KRRVGLNEPKH

SEQ ID NO: 2271 - protein, 11 aa, Artificial
  IGFBP-2 heparin binding domain-containing peptide sequence
RRRVGLNEPKH

SEQ ID NO: 2272 - protein, 11 aa, Artificial
  IGFBP-2 heparin binding domain-containing peptide sequence
HRRVGLNEPKH

SEQ ID NO: 2273 - protein, 11 aa, Artificial
  IGFBP-2 heparin binding domain-containing peptide sequence
KHHLGINEPKH

SEQ ID NO: 2274 - protein, 11 aa, Artificial
  IGFBP-2 heparin binding domain-containing peptide sequence
RHHLGINEPKH

SEQ ID NO: 2275 - protein, 11 aa, Artificial
  IGFBP-2 heparin binding domain-containing peptide sequence
HHHLGINEPKH

SEQ ID NO: 2276 - protein, 11 aa, Artificial
  IGFBP-2 heparin binding domain-containing peptide sequence
KKHLGINEPKH

SEQ ID NO: 2277 - protein, 11 aa, Artificial
  IGFBP-2 heparin binding domain-containing peptide sequence
RKHLGINEPKH

SEQ ID NO: 2278 - protein, 11 aa, Artificial
  IGFBP-2 heparin binding domain-containing peptide sequence
HKHLGINEPKH

SEQ ID NO: 2279 - protein, 11 aa, Artificial
  IGFBP-2 heparin binding domain-containing peptide sequence
KRHLGINEPKH

SEQ ID NO: 2280 - protein, 11 aa, Artificial
  IGFBP-2 heparin binding domain-containing peptide sequence
RRHLGINEPKH

SEQ ID NO: 2281 - protein, 11 aa, Artificial
  IGFBP-2 heparin binding domain-containing peptide sequence
HRHLGINEPKH

SEQ ID NO: 2282 - protein, 11 aa, Artificial
  IGFBP-2 heparin binding domain-containing peptide sequence
KHKLGINEPKH

SEQ ID NO: 2283 - protein, 11 aa, Artificial
  IGFBP-2 heparin binding domain-containing peptide sequence
RHKLGINEPKH

SEQ ID NO: 2284 - protein, 11 aa, Artificial
  IGFBP-2 heparin binding domain-containing peptide sequence
HHKLGINEPKH

SEQ ID NO: 2285 - protein, 11 aa, Artificial
  IGFBP-2 heparin binding domain-containing peptide sequence
KKKLGINEPKH

SEQ ID NO: 2286 - protein, 11 aa, Artificial
  IGFBP-2 heparin binding domain-containing peptide sequence
RKKLGINEPKH

SEQ ID NO: 2287 - protein, 11 aa, Artificial
  IGFBP-2 heparin binding domain-containing peptide sequence
HKKLGINEPKH

SEQ ID NO: 2288 - protein, 11 aa, Artificial
  IGFBP-2 heparin binding domain-containing peptide sequence
KRKLGINEPKH

SEQ ID NO: 2289 - protein, 11 aa, Artificial
  IGFBP-2 heparin binding domain-containing peptide sequence
RRKLGINEPKH

SEQ ID NO: 2290 - protein, 11 aa, Artificial
  IGFBP-2 heparin binding domain-containing peptide sequence
HRKLGINEPKH

SEQ ID NO: 2291 - protein, 11 aa, Artificial
  IGFBP-2 heparin binding domain-containing peptide sequence
KHRLGINEPKH

SEQ ID NO: 2292 - protein, 11 aa, Artificial
  IGFBP-2 heparin binding domain-containing peptide sequence
RHRLGINEPKH

SEQ ID NO: 2293 - protein, 11 aa, Artificial
  IGFBP-2 heparin binding domain-containing peptide sequence
HHRLGINEPKH

SEQ ID NO: 2294 - protein, 11 aa, Artificial
  IGFBP-2 heparin binding domain-containing peptide sequence
KKRLGINEPKH

SEQ ID NO: 2295 - protein, 11 aa, Artificial
  IGFBP-2 heparin binding domain-containing peptide sequence
RKRLGINEPKH

SEQ ID NO: 2296 - protein, 11 aa, Artificial
  IGFBP-2 heparin binding domain-containing peptide sequence
HKRLGINEPKH

SEQ ID NO: 2297 - protein, 11 aa, Artificial
  IGFBP-2 heparin binding domain-containing peptide sequence
KRRLGINEPKH

SEQ ID NO: 2298 - protein, 11 aa, Artificial
  IGFBP-2 heparin binding domain-containing peptide sequence
RRRLGINEPKH

SEQ ID NO: 2299 - protein, 11 aa, Artificial
  IGFBP-2 heparin binding domain-containing peptide sequence
HRRLGINEPKH

SEQ ID NO: 2300 - protein, 11 aa, Artificial
  IGFBP-2 heparin binding domain-containing peptide sequence
KHHIGIENPKH

SEQ ID NO: 2301 - protein, 11 aa, Artificial
  IGFBP-2 heparin binding domain-containing peptide sequence
RHHIGINEPKH

SEQ ID NO: 2302 - protein, 11 aa, Artificial
  IGFBP-2 heparin binding domain-containing peptide sequence
HHHIGINEPKH

SEQ ID NO: 2303 - protein, 11 aa, Artificial
  IGFBP-2 heparin binding domain-containing peptide sequence
KKHIGINEPKH

SEQ ID NO: 2304 - protein, 11 aa, Artificial
  IGFBP-2 heparin binding domain-containing peptide sequence
RKHIGINEPKH

SEQ ID NO: 2305 - protein, 11 aa, Artificial
  IGFBP-2 heparin binding domain-containing peptide sequence
HKHIGINEPKH

SEQ ID NO: 2306 - protein, 11 aa, Artificial
  IGFBP-2 heparin binding domain-containing peptide sequence
KRHIGINEPKH

SEQ ID NO: 2307 - protein, 11 aa, Artificial
  IGFBP-2 heparin binding domain-containing peptide sequence
RRHIGINEPKH

SEQ ID NO: 2308 - protein, 11 aa, Artificial
  IGFBP-2 heparin binding domain-containing peptide sequence
HRHIGINEPKH

SEQ ID NO: 2309 - protein, 11 aa, Artificial
  IGFBP-2 heparin binding domain-containing peptide sequence
KHKIGINEPKH

SEQ ID NO: 2310 - protein, 11 aa, Artificial
  IGFBP-2 heparin binding domain-containing peptide sequence
RHKIGINEPKH

SEQ ID NO: 2311 - protein, 11 aa, Artificial
  IGFBP-2 heparin binding domain-containing peptide sequence
HHKIGINEPKH

SEQ ID NO: 2312 - protein, 11 aa, Artificial
  IGFBP-2 heparin binding domain-containing peptide sequence
KKKIGINEPKH

SEQ ID NO: 2313 - protein, 11 aa, Artificial
  IGFBP-2 heparin binding domain-containing peptide sequence
RKKIGINEPKH

SEQ ID NO: 2314 - protein, 11 aa, Artificial
  IGFBP-2 heparin binding domain-containing peptide sequence
HKKIGINEPKH

SEQ ID NO: 2315 - protein, 11 aa, Artificial
  IGFBP-2 heparin binding domain-containing peptide sequence
KRKIGINEPKH

SEQ ID NO: 2316 - protein, 11 aa, Artificial
  IGFBP-2 heparin binding domain-containing peptide sequence
RRKIGINEPKH

SEQ ID NO: 2317 - protein, 11 aa, Artificial
  IGFBP-2 heparin binding domain-containing peptide sequence
HRKIGINEPKH

SEQ ID NO: 2318 - protein, 11 aa, Artificial
  IGFBP-2 heparin binding domain-containing peptide sequence
KHRIGINEPKH

SEQ ID NO: 2319 - protein, 11 aa, Artificial
  IGFBP-2 heparin binding domain-containing peptide sequence
RHRIGINEPKH

SEQ ID NO: 2320 - protein, 11 aa, Artificial
  IGFBP-2 heparin binding domain-containing peptide sequence
HHRIGINEPKH

SEQ ID NO: 2321 - protein, 11 aa, Artificial
  IGFBP-2 heparin binding domain-containing peptide sequence
KKRIGINEPKH

SEQ ID NO: 2322 - protein, 11 aa, Artificial
  IGFBP-2 heparin binding domain-containing peptide sequence
RKRIGINEPKH

SEQ ID NO: 2323 - protein, 11 aa, Artificial
  IGFBP-2 heparin binding domain-containing peptide sequence
HKRIGINEPKH

SEQ ID NO: 2324 - protein, 11 aa, Artificial
  IGFBP-2 heparin binding domain-containing peptide sequence
KRRIGINEPKH

SEQ ID NO: 2325 - protein, 11 aa, Artificial
  IGFBP-2 heparin binding domain-containing peptide sequence
RRRIGINEPKH

SEQ ID NO: 2326 - protein, 11 aa, Artificial
  IGFBP-2 heparin binding domain-containing peptide sequence
HRRIGINEPKH

SEQ ID NO: 2327 - protein, 11 aa, Artificial
  IGFBP-2 heparin binding domain-containing peptide sequence
KHHVGINEPKH

SEQ ID NO: 2328 - protein, 11 aa, Artificial
  IGFBP-2 heparin binding domain-containing peptide sequence
RHHVGINEPKH

SEQ ID NO: 2329 - protein, 11 aa, Artificial
  IGFBP-2 heparin binding domain-containing peptide sequence
HHHVGINEPKH

SEQ ID NO: 2330 - protein, 11 aa, Artificial
  IGFBP-2 heparin binding domain-containing peptide sequence
KKHVGINEPKH

SEQ ID NO: 2331 - protein, 11 aa, Artificial
  IGFBP-2 heparin binding domain-containing peptide sequence
RKHVGINEPKH

SEQ ID NO: 2332 - protein, 11 aa, Artificial
  IGFBP-2 heparin binding domain-containing peptide sequence
HKHVGINEPKH

SEQ ID NO: 2333 - protein, 11 aa, Artificial
  IGFBP-2 heparin binding domain-containing peptide sequence
KRHVGINEPKH

SEQ ID NO: 2334 - protein, 11 aa, Artificial
  IGFBP-2 heparin binding domain-containing peptide sequence
RRHVGINEPKH

SEQ ID NO: 2335 - protein, 11 aa, Artificial
  IGFBP-2 heparin binding domain-containing peptide sequence
HRHVGINEPKH

SEQ ID NO: 2336 - protein, 11 aa, Artificial
  IGFBP-2 heparin binding domain-containing peptide sequence
KHKVGINEPKH

SEQ ID NO: 2337 - protein, 11 aa, Artificial
  IGFBP-2 heparin binding domain-containing peptide sequence
RHKVGINEPKH

SEQ ID NO: 2338 - protein, 11 aa, Artificial
  IGFBP-2 heparin binding domain-containing peptide sequence
HHKVGINEPKH

SEQ ID NO: 2339 - protein, 11 aa, Artificial
  IGFBP-2 heparin binding domain-containing peptide sequence
KKKVGINEPKH

SEQ ID NO: 2340 - protein, 11 aa, Artificial
  IGFBP-2 heparin binding domain-containing peptide sequence
RKKVGINEPKH

SEQ ID NO: 2341 - protein, 11 aa, Artificial
  IGFBP-2 heparin binding domain-containing peptide sequence
HKKVGINEPKH

SEQ ID NO: 2342 - protein, 11 aa, Artificial
  IGFBP-2 heparin binding domain-containing peptide sequence
KRKVGINEPKH

SEQ ID NO: 2343 - protein, 11 aa, Artificial
  IGFBP-2 heparin binding domain-containing peptide sequence
RRKVGINEPKH

SEQ ID NO: 2344 - protein, 11 aa, Artificial
  IGFBP-2 heparin binding domain-containing peptide sequence
HRKVGINEPKH

SEQ ID NO: 2345 - protein, 11 aa, Artificial
  IGFBP-2 heparin binding domain-containing peptide sequence
KHRVGINEPKH

SEQ ID NO: 2346 - protein, 11 aa, Artificial
  IGFBP-2 heparin binding domain-containing peptide sequence
RHRVGINEPKH

SEQ ID NO: 2347 - protein, 11 aa, Artificial
  IGFBP-2 heparin binding domain-containing peptide sequence
HHRVGINEPKH

SEQ ID NO: 2348 - protein, 11 aa, Artificial
  IGFBP-2 heparin binding domain-containing peptide sequence
KKRVGINEPKH

SEQ ID NO: 2349 - protein, 11 aa, Artificial
  IGFBP-2 heparin binding domain-containing peptide sequence
RKRVGINEPKH

SEQ ID NO: 2350 - protein, 11 aa, Artificial
  IGFBP-2 heparin binding domain-containing peptide sequence
HKRVGINEPKH

SEQ ID NO: 2351 - protein, 11 aa, Artificial
  IGFBP-2 heparin binding domain-containing peptide sequence
KRRVGINEPKH

SEQ ID NO: 2352 - protein, 11 aa, Artificial
  IGFBP-2 heparin binding domain-containing peptide sequence
RRRVGINEPKH

SEQ ID NO: 2353 - protein, 11 aa, Artificial
  IGFBP-2 heparin binding domain-containing peptide sequence
HRRVGINEPKH

SEQ ID NO: 2354 - protein, 11 aa, Artificial
  IGFBP-2 heparin binding domain-containing peptide sequence
KHHLGVNEPKH

SEQ ID NO: 2355 - protein, 11 aa, Artificial
  IGFBP-2 heparin binding domain-containing peptide sequence
RHHLGVNEPKH

SEQ ID NO: 2356 - protein, 11 aa, Artificial
  IGFBP-2 heparin binding domain-containing peptide sequence
HHHLGVNEPKH

SEQ ID NO: 2357 - protein, 11 aa, Artificial
  IGFBP-2 heparin binding domain-containing peptide sequence
KKHLGVNEPKH

SEQ ID NO: 2358 - protein, 11 aa, Artificial
  IGFBP-2 heparin binding domain-containing peptide sequence
RKHLGVNEPKH

SEQ ID NO: 2359 - protein, 11 aa, Artificial
  IGFBP-2 heparin binding domain-containing peptide sequence
HKHLGVNEPKH

SEQ ID NO: 2360 - protein, 11 aa, Artificial
  IGFBP-2 heparin binding domain-containing peptide sequence
KRHLGVNEPKH

SEQ ID NO: 2361 - protein, 11 aa, Artificial
  IGFBP-2 heparin binding domain-containing peptide sequence
RRHLGVNEPKH

SEQ ID NO: 2362 - protein, 11 aa, Artificial
  IGFBP-2 heparin binding domain-containing peptide sequence
HRHLGVNEPKH

SEQ ID NO: 2363 - protein, 11 aa, Artificial
  IGFBP-2 heparin binding domain-containing peptide sequence
KHKLGVNEPKH

SEQ ID NO: 2364 - protein, 11 aa, Artificial
  IGFBP-2 heparin binding domain-containing peptide sequence
RHKLGVNEPKH

SEQ ID NO: 2365 - protein, 11 aa, Artificial
  IGFBP-2 heparin binding domain-containing peptide sequence
HHKLGVNEPKH

SEQ ID NO: 2366 - protein, 11 aa, Artificial
  IGFBP-2 heparin binding domain-containing peptide sequence
KKKLGVNEPKH

SEQ ID NO: 2367 - protein, 11 aa, Artificial
  IGFBP-2 heparin binding domain-containing peptide sequence
RKKLGVNEPKH

SEQ ID NO: 2368 - protein, 11 aa, Artificial
  IGFBP-2 heparin binding domain-containing peptide sequence
HKKLGVNEPKH

SEQ ID NO: 2369 - protein, 11 aa, Artificial
  IGFBP-2 heparin binding domain-containing peptide sequence
KRKLGVNEPKH

SEQ ID NO: 2370 - protein, 11 aa, Artificial
  IGFBP-2 heparin binding domain-containing peptide sequence
RRKLGVNEPKH

SEQ ID NO: 2371 - protein, 11 aa, Artificial
  IGFBP-2 heparin binding domain-containing peptide sequence
HRKLGVNEPKH

SEQ ID NO: 2372 - protein, 11 aa, Artificial
  IGFBP-2 heparin binding domain-containing peptide sequence
KHRLGVNEPKH

SEQ ID NO: 2373 - protein, 11 aa, Artificial
  IGFBP-2 heparin binding domain-containing peptide sequence
RHRLGVNEPKH

SEQ ID NO: 2374 - protein, 11 aa, Artificial
  IGFBP-2 heparin binding domain-containing peptide sequence
HHRLGVNEPKH

SEQ ID NO: 2375 - protein, 11 aa, Artificial
  IGFBP-2 heparin binding domain-containing peptide sequence
KKRLGVNEPKH

SEQ ID NO: 2376 - protein, 11 aa, Artificial
  IGFBP-2 heparin binding domain-containing peptide sequence
RKRLGVNEPKH

SEQ ID NO: 2377 - protein, 11 aa, Artificial
  IGFBP-2 heparin binding domain-containing peptide sequence
HKRLGVNEPKH

SEQ ID NO: 2378 - protein, 11 aa, Artificial
  IGFBP-2 heparin binding domain-containing peptide sequence
KRRLGVNEPKH

SEQ ID NO: 2379 - protein, 11 aa, Artificial
  IGFBP-2 heparin binding domain-containing peptide sequence
RRRLGVNEPKH

SEQ ID NO: 2380 - protein, 11 aa, Artificial
  IGFBP-2 heparin binding domain-containing peptide sequence
HRRLGVNEPKH

SEQ ID NO: 2381 - protein, 11 aa, Artificial
  IGFBP-2 heparin binding domain-containing peptide sequence
KHHIGVNEPKH

SEQ ID NO: 2382 - protein, 11 aa, Artificial
  IGFBP-2 heparin binding domain-containing peptide sequence
RHHIGVNEPKH

SEQ ID NO: 2383 - protein, 11 aa, Artificial
  IGFBP-2 heparin binding domain-containing peptide sequence
HHHIGVNEPKH

SEQ ID NO: 2384 - protein, 11 aa, Artificial
  IGFBP-2 heparin binding domain-containing peptide sequence
KKHIGVNEPKH

SEQ ID NO: 2385 - protein, 11 aa, Artificial
  IGFBP-2 heparin binding domain-containing peptide sequence
RKHIGVNEPKH

SEQ ID NO: 2386 - protein, 11 aa, Artificial
  IGFBP-2 heparin binding domain-containing peptide sequence
HKHIGVNEPKH

SEQ ID NO: 2387 - protein, 11 aa, Artificial
  IGFBP-2 heparin binding domain-containing peptide sequence
KRHIGVNEPKH

SEQ ID NO: 2388 - protein, 11 aa, Artificial
  IGFBP-2 heparin binding domain-containing peptide sequence
RRHIGVNEPKH

SEQ ID NO: 2389 - protein, 11 aa, Artificial
  IGFBP-2 heparin binding domain-containing peptide sequence
HRHIGVNEPKH

SEQ ID NO: 2390 - protein, 11 aa, Artificial
  IGFBP-2 heparin binding domain-containing peptide sequence
KHKIGVNEPKH

SEQ ID NO: 2391 - protein, 11 aa, Artificial
  IGFBP-2 heparin binding domain-containing peptide sequence
RHKIGVNEPKH

SEQ ID NO: 2392 - protein, 11 aa, Artificial
  IGFBP-2 heparin binding domain-containing peptide sequence
HHKIGVNEPKH

SEQ ID NO: 2393 - protein, 11 aa, Artificial
  IGFBP-2 heparin binding domain-containing peptide sequence
KKKIGVNEPKH

SEQ ID NO: 2394 - protein, 11 aa, Artificial
  IGFBP-2 heparin binding domain-containing peptide sequence
RKKIGVNEPKH

SEQ ID NO: 2395 - protein, 11 aa, Artificial
  IGFBP-2 heparin binding domain-containing peptide sequence
HKKIGVNEPKH

SEQ ID NO: 2396 - protein, 11 aa, Artificial
  IGFBP-2 heparin binding domain-containing peptide sequence
KRKIGVNEPKH

SEQ ID NO: 2397 - protein, 11 aa, Artificial
  IGFBP-2 heparin binding domain-containing peptide sequence
RRKIGVNEPKH

SEQ ID NO: 2398 - protein, 11 aa, Artificial
  IGFBP-2 heparin binding domain-containing peptide sequence
HRKIGVNEPKH

SEQ ID NO: 2399 - protein, 11 aa, Artificial
  IGFBP-2 heparin binding domain-containing peptide sequence
KHRIGVNEPKH

SEQ ID NO: 2400 - protein, 11 aa, Artificial
  IGFBP-2 heparin binding domain-containing peptide sequence
RHRIGVNEPKH

SEQ ID NO: 2401 - protein, 11 aa, Artificial
  IGFBP-2 heparin binding domain-containing peptide sequence
HHRIGVNEPKH

SEQ ID NO: 2402 - protein, 11 aa, Artificial
  IGFBP-2 heparin binding domain-containing peptide sequence
KKRIGVNEPKH

SEQ ID NO: 2403 - protein, 11 aa, Artificial
  IGFBP-2 heparin binding domain-containing peptide sequence
RKRIGVNEPKH

SEQ ID NO: 2404 - protein, 11 aa, Artificial
  IGFBP-2 heparin binding domain-containing peptide sequence
HKRIGVNEPKH

SEQ ID NO: 2405 - protein, 11 aa, Artificial
  IGFBP-2 heparin binding domain-containing peptide sequence
KRRIGVNEPKH

SEQ ID NO: 2406 - protein, 11 aa, Artificial
  IGFBP-2 heparin binding domain-containing peptide sequence
RRRIGVNEPKH

SEQ ID NO: 2407 - protein, 11 aa, Artificial
  IGFBP-2 heparin binding domain-containing peptide sequence
HRRIGVNEPKH

SEQ ID NO: 2408 - protein, 11 aa, Artificial
  IGFBP-2 heparin binding domain-containing peptide sequence
KHHVGVNEPKH

SEQ ID NO: 2409 - protein, 11 aa, Artificial
  IGFBP-2 heparin binding domain-containing peptide sequence
RHHVGVNEPKH

SEQ ID NO: 2410 - protein, 11 aa, Artificial
  IGFBP-2 heparin binding domain-containing peptide sequence
HHHVGVNEPKH

SEQ ID NO: 2411 - protein, 11 aa, Artificial
  IGFBP-2 heparin binding domain-containing peptide sequence
KKHVGVNEPKH

SEQ ID NO: 2412 - protein, 11 aa, Artificial
  IGFBP-2 heparin binding domain-containing peptide sequence
RKHVGVNEPKH

SEQ ID NO: 2413 - protein, 11 aa, Artificial
  IGFBP-2 heparin binding domain-containing peptide sequence
HKHVGVNEPKH

SEQ ID NO: 2414 - protein, 11 aa, Artificial
  IGFBP-2 heparin binding domain-containing peptide sequence
KRHVGVNEPKH

SEQ ID NO: 2415 - protein, 11 aa, Artificial
  IGFBP-2 heparin binding domain-containing peptide sequence
RRHVGVNEPKH

SEQ ID NO: 2416 - protein, 11 aa, Artificial
  IGFBP-2 heparin binding domain-containing peptide sequence
HRHVGVNEPKH

SEQ ID NO: 2417 - protein, 11 aa, Artificial
  IGFBP-2 heparin binding domain-containing peptide sequence
KHKVGVNEPKH

SEQ ID NO: 2418 - protein, 11 aa, Artificial
  IGFBP-2 heparin binding domain-containing peptide sequence
RHKVGVNEPKH

SEQ ID NO: 2419 - protein, 11 aa, Artificial
  IGFBP-2 heparin binding domain-containing peptide sequence
HHKVGVNEPKH

SEQ ID NO: 2420 - protein, 11 aa, Artificial
  IGFBP-2 heparin binding domain-containing peptide sequence
KKKVGVNEPKH

SEQ ID NO: 2421 - protein, 11 aa, Artificial
  IGFBP-2 heparin binding domain-containing peptide sequence
RKKVGVNEPKH

SEQ ID NO: 2422 - protein, 11 aa, Artificial
  IGFBP-2 heparin binding domain-containing peptide sequence
HKKVGVNEPKH

SEQ ID NO: 2423 - protein, 11 aa, Artificial
  IGFBP-2 heparin binding domain-containing peptide sequence
KRKVGVNEPKH

SEQ ID NO: 2424 - protein, 11 aa, Artificial
  IGFBP-2 heparin binding domain-containing peptide sequence
RRKVGVNEPKH

SEQ ID NO: 2425 - protein, 11 aa, Artificial
  IGFBP-2 heparin binding domain-containing peptide sequence
HRKVGVNEPKH

SEQ ID NO: 2426 - protein, 11 aa, Artificial
  IGFBP-2 heparin binding domain-containing peptide sequence
KHRVGVNEPKH

SEQ ID NO: 2427 - protein, 11 aa, Artificial
  IGFBP-2 heparin binding domain-containing peptide sequence
RHRVGVNEPKH

SEQ ID NO: 2428 - protein, 11 aa, Artificial
  IGFBP-2 heparin binding domain-containing peptide sequence
HHRVGVNEPKH

SEQ ID NO: 2429 - protein, 11 aa, Artificial
  IGFBP-2 heparin binding domain-containing peptide sequence
KKRVGVNEPKH

SEQ ID NO: 2430 - protein, 11 aa, Artificial
  IGFBP-2 heparin binding domain-containing peptide sequence
RKRVGVNEPKH

SEQ ID NO: 2431 - protein, 11 aa, Artificial
  IGFBP-2 heparin binding domain-containing peptide sequence
HKRVGVNEPKH

SEQ ID NO: 2432 - protein, 11 aa, Artificial
  IGFBP-2 heparin binding domain-containing peptide sequence
KRRVGVNEPKH

SEQ ID NO: 2433 - protein, 11 aa, Artificial
  IGFBP-2 heparin binding domain-containing peptide sequence
RRRVGVNEPKH

SEQ ID NO: 2434 - protein, 11 aa, Artificial
  IGFBP-2 heparin binding domain-containing peptide sequence
HRRVGVNEPKH

SEQ ID NO: 2435 - protein, 11 aa, Artificial
  IGFBP-2 heparin binding domain-containing peptide sequence
KHHLGLENPKH

SEQ ID NO: 2436 - protein, 11 aa, Artificial
  IGFBP-2 heparin binding domain-containing peptide sequence
RHHLGLENPKH

SEQ ID NO: 2437 - protein, 11 aa, Artificial
  IGFBP-2 heparin binding domain-containing peptide sequence
HHHLGLENPKH

SEQ ID NO: 2438 - protein, 11 aa, Artificial
  IGFBP-2 heparin binding domain-containing peptide sequence
KKHLGLENPKH

SEQ ID NO: 2439 - protein, 11 aa, Artificial
  IGFBP-2 heparin binding domain-containing peptide sequence
RKHLGLENPKH

SEQ ID NO: 2440 - protein, 11 aa, Artificial
  IGFBP-2 heparin binding domain-containing peptide sequence
HKHLGLENPKH

SEQ ID NO: 2441 - protein, 11 aa, Artificial
  IGFBP-2 heparin binding domain-containing peptide sequence
KRHLGLENPKH

SEQ ID NO: 2442 - protein, 11 aa, Artificial
  IGFBP-2 heparin binding domain-containing peptide sequence
RRHLGLENPKH

SEQ ID NO: 2443 - protein, 11 aa, Artificial
  IGFBP-2 heparin binding domain-containing peptide sequence
HRHLGLENPKH

SEQ ID NO: 2444 - protein, 11 aa, Artificial
  IGFBP-2 heparin binding domain-containing peptide sequence
KHKLGLENPKH

SEQ ID NO: 2445 - protein, 11 aa, Artificial
  IGFBP-2 heparin binding domain-containing peptide sequence
RHKLGLENPKH

SEQ ID NO: 2446 - protein, 11 aa, Artificial
  IGFBP-2 heparin binding domain-containing peptide sequence
HHKLGLENPKH

SEQ ID NO: 2447 - protein, 11 aa, Artificial
  IGFBP-2 heparin binding domain-containing peptide sequence
KKKLGLENPKH

SEQ ID NO: 2448 - protein, 11 aa, Artificial
  IGFBP-2 heparin binding domain-containing peptide sequence
RKKLGLENPKH

SEQ ID NO: 2449 - protein, 11 aa, Artificial
  IGFBP-2 heparin binding domain-containing peptide sequence
HKKLGLENPKH

SEQ ID NO: 2450 - protein, 11 aa, Artificial
  IGFBP-2 heparin binding domain-containing peptide sequence
KRKLGLENPKH

SEQ ID NO: 2451 - protein, 11 aa, Artificial
  IGFBP-2 heparin binding domain-containing peptide sequence
RRKLGLENPKH

SEQ ID NO: 2452 - protein, 11 aa, Artificial
  IGFBP-2 heparin binding domain-containing peptide sequence
HRKLGLENPKH

SEQ ID NO: 2453 - protein, 11 aa, Artificial
  IGFBP-2 heparin binding domain-containing peptide sequence
KHRLGLENPKH

SEQ ID NO: 2454 - protein, 11 aa, Artificial
  IGFBP-2 heparin binding domain-containing peptide sequence
RHRLGLENPKH

SEQ ID NO: 2455 - protein, 11 aa, Artificial
  IGFBP-2 heparin binding domain-containing peptide sequence
HHRLGLENPKH

SEQ ID NO: 2456 - protein, 11 aa, Artificial
  IGFBP-2 heparin binding domain-containing peptide sequence
KKRLGLENPKH

SEQ ID NO: 2457 - protein, 11 aa, Artificial
  IGFBP-2 heparin binding domain-containing peptide sequence
RKRLGLENPKH

SEQ ID NO: 2458 - protein, 11 aa, Artificial
  IGFBP-2 heparin binding domain-containing peptide sequence
HKRLGLENPKH

SEQ ID NO: 2459 - protein, 11 aa, Artificial
  IGFBP-2 heparin binding domain-containing peptide sequence
KRRLGLENPKH

SEQ ID NO: 2460 - protein, 11 aa, Artificial
  IGFBP-2 heparin binding domain-containing peptide sequence
RRRLGLENPKH

SEQ ID NO: 2461 - protein, 11 aa, Artificial
  IGFBP-2 heparin binding domain-containing peptide sequence
HRRLGLENPKH

SEQ ID NO: 2462 - protein, 11 aa, Artificial
  IGFBP-2 heparin binding domain-containing peptide sequence
KHHIGLENPKH

SEQ ID NO: 2463 - protein, 11 aa, Artificial
  IGFBP-2 heparin binding domain-containing peptide sequence
RHHIGLENPKH

SEQ ID NO: 2464 - protein, 11 aa, Artificial
  IGFBP-2 heparin binding domain-containing peptide sequence
HHHIGLENPKH

SEQ ID NO: 2465 - protein, 11 aa, Artificial
  IGFBP-2 heparin binding domain-containing peptide sequence
KKHIGLENPKH

SEQ ID NO: 2466 - protein, 11 aa, Artificial
  IGFBP-2 heparin binding domain-containing peptide sequence
RKHIGLENPKH

SEQ ID NO: 2467 - protein, 11 aa, Artificial
  IGFBP-2 heparin binding domain-containing peptide sequence
HKHIGLENPKH

SEQ ID NO: 2468 - protein, 11 aa, Artificial
  IGFBP-2 heparin binding domain-containing peptide sequence
KRHIGLENPKH

SEQ ID NO: 2469 - protein, 11 aa, Artificial
  IGFBP-2 heparin binding domain-containing peptide sequence
RRHIGLENPKH

SEQ ID NO: 2470 - protein, 11 aa, Artificial
  IGFBP-2 heparin binding domain-containing peptide sequence
HRHIGLENPKH

SEQ ID NO: 2471 - protein, 11 aa, Artificial
  IGFBP-2 heparin binding domain-containing peptide sequence
KHKIGLENPKH

SEQ ID NO: 2472 - protein, 11 aa, Artificial
  IGFBP-2 heparin binding domain-containing peptide sequence
RHKIGLENPKH

SEQ ID NO: 2473 - protein, 11 aa, Artificial
  IGFBP-2 heparin binding domain-containing peptide sequence
HHKIGLENPKH

SEQ ID NO: 2474 - protein, 11 aa, Artificial
  IGFBP-2 heparin binding domain-containing peptide sequence
KKKIGLENPKH

SEQ ID NO: 2475 - protein, 11 aa, Artificial
  IGFBP-2 heparin binding domain-containing peptide sequence
RKKIGLENPKH

SEQ ID NO: 2476 - protein, 11 aa, Artificial
  IGFBP-2 heparin binding domain-containing peptide sequence
HKKIGLENPKH

SEQ ID NO: 2477 - protein, 11 aa, Artificial
  IGFBP-2 heparin binding domain-containing peptide sequence
KRKIGLENPKH

SEQ ID NO: 2478 - protein, 11 aa, Artificial
  IGFBP-2 heparin binding domain-containing peptide sequence
RRKIGLENPKH

SEQ ID NO: 2479 - protein, 11 aa, Artificial
  IGFBP-2 heparin binding domain-containing peptide sequence
HRKIGLENPKH

SEQ ID NO: 2480 - protein, 11 aa, Artificial
  IGFBP-2 heparin binding domain-containing peptide sequence
KHRIGLENPKH

SEQ ID NO: 2481 - protein, 11 aa, Artificial
  IGFBP-2 heparin binding domain-containing peptide sequence
RHRIGLENPKH

SEQ ID NO: 2482 - protein, 11 aa, Artificial
  IGFBP-2 heparin binding domain-containing peptide sequence
HHRIGLENPKH

SEQ ID NO: 2483 - protein, 11 aa, Artificial
  IGFBP-2 heparin binding domain-containing peptide sequence
KKRIGLENPKH

SEQ ID NO: 2484 - protein, 11 aa, Artificial
  IGFBP-2 heparin binding domain-containing peptide sequence
RKRIGLENPKH

SEQ ID NO: 2485 - protein, 11 aa, Artificial
  IGFBP-2 heparin binding domain-containing peptide sequence
HKRIGLENPKH

SEQ ID NO: 2486 - protein, 11 aa, Artificial
  IGFBP-2 heparin binding domain-containing peptide sequence
KRRIGLENPKH

SEQ ID NO: 2487 - protein, 11 aa, Artificial
  IGFBP-2 heparin binding domain-containing peptide sequence
RRRIGLENPKH

SEQ ID NO: 2488 - protein, 11 aa, Artificial
  IGFBP-2 heparin binding domain-containing peptide sequence
HRRIGLENPKH

SEQ ID NO: 2489 - protein, 11 aa, Artificial
  IGFBP-2 heparin binding domain-containing peptide sequence
KHHVGLENPKH

SEQ ID NO: 2490 - protein, 11 aa, Artificial
  IGFBP-2 heparin binding domain-containing peptide sequence
RHHVGLENPKH

SEQ ID NO: 2491 - protein, 11 aa, Artificial
  IGFBP-2 heparin binding domain-containing peptide sequence
HHHVGLENPKH

SEQ ID NO: 2492 - protein, 11 aa, Artificial
  IGFBP-2 heparin binding domain-containing peptide sequence
KKHVGLENPKH

SEQ ID NO: 2493 - protein, 11 aa, Artificial
  IGFBP-2 heparin binding domain-containing peptide sequence
RKHVGLENPKH

SEQ ID NO: 2494 - protein, 11 aa, Artificial
  IGFBP-2 heparin binding domain-containing peptide sequence
HKHVGLENPKH

SEQ ID NO: 2495 - protein, 11 aa, Artificial
  IGFBP-2 heparin binding domain-containing peptide sequence
KRHVGLENPKH

SEQ ID NO: 2496 - protein, 11 aa, Artificial
  IGFBP-2 heparin binding domain-containing peptide sequence
RRHVGLENPKH

SEQ ID NO: 2497 - protein, 11 aa, Artificial
  IGFBP-2 heparin binding domain-containing peptide sequence
HRHVGLENPKH

SEQ ID NO: 2498 - protein, 11 aa, Artificial
  IGFBP-2 heparin binding domain-containing peptide sequence
KHKVGLENPKH

SEQ ID NO: 2499 - protein, 11 aa, Artificial
  IGFBP-2 heparin binding domain-containing peptide sequence
RHKVGLENPKH

SEQ ID NO: 2500 - protein, 11 aa, Artificial
  IGFBP-2 heparin binding domain-containing peptide sequence
HHKVGLENPKH

SEQ ID NO: 2501 - protein, 11 aa, Artificial
  IGFBP-2 heparin binding domain-containing peptide sequence
KKKVGLENPKH

SEQ ID NO: 2502 - protein, 11 aa, Artificial
  IGFBP-2 heparin binding domain-containing peptide sequence
RKKVGLENPKH

SEQ ID NO: 2503 - protein, 11 aa, Artificial
  IGFBP-2 heparin binding domain-containing peptide sequence
HKKVGLENPKH

SEQ ID NO: 2504 - protein, 11 aa, Artificial
  IGFBP-2 heparin binding domain-containing peptide sequence
KRKVGLENPKH

SEQ ID NO: 2505 - protein, 11 aa, Artificial
  IGFBP-2 heparin binding domain-containing peptide sequence
RRKVGLENPKH

SEQ ID NO: 2506 - protein, 11 aa, Artificial
  IGFBP-2 heparin binding domain-containing peptide sequence
HRKVGLENPKH

SEQ ID NO: 2507 - protein, 11 aa, Artificial
  IGFBP-2 heparin binding domain-containing peptide sequence
KHRVGLENPKH

SEQ ID NO: 2508 - protein, 11 aa, Artificial
  IGFBP-2 heparin binding domain-containing peptide sequence
RHRVGLENPKH

SEQ ID NO: 2509 - protein, 11 aa, Artificial
  IGFBP-2 heparin binding domain-containing peptide sequence
HHRVGLENPKH

SEQ ID NO: 2510 - protein, 11 aa, Artificial
  IGFBP-2 heparin binding domain-containing peptide sequence
KKRVGLENPKH

SEQ ID NO: 2511 - protein, 11 aa, Artificial
  IGFBP-2 heparin binding domain-containing peptide sequence
RKRVGLENPKH

SEQ ID NO: 2512 - protein, 11 aa, Artificial
  IGFBP-2 heparin binding domain-containing peptide sequence
HKRVGLENPKH

SEQ ID NO: 2513 - protein, 11 aa, Artificial
  IGFBP-2 heparin binding domain-containing peptide sequence
KRRVGLENPKH

SEQ ID NO: 2514 - protein, 11 aa, Artificial
  IGFBP-2 heparin binding domain-containing peptide sequence
RRRVGLENPKH

SEQ ID NO: 2515 - protein, 11 aa, Artificial
  IGFBP-2 heparin binding domain-containing peptide sequence
HRRVGLENPKH

SEQ ID NO: 2516 - protein, 11 aa, Artificial
  IGFBP-2 heparin binding domain-containing peptide sequence
KHHLGIENPKH

SEQ ID NO: 2517 - protein, 11 aa, Artificial
  IGFBP-2 heparin binding domain-containing peptide sequence
RHHLGIENPKH

SEQ ID NO: 2518 - protein, 11 aa, Artificial
  IGFBP-2 heparin binding domain-containing peptide sequence
HHHLGIENPKH

SEQ ID NO: 2519 - protein, 11 aa, Artificial
  IGFBP-2 heparin binding domain-containing peptide sequence
KKHLGIENPKH

SEQ ID NO: 2520 - protein, 11 aa, Artificial
  IGFBP-2 heparin binding domain-containing peptide sequence
RKHLGIENPKH

SEQ ID NO: 2521 - protein, 11 aa, Artificial
  IGFBP-2 heparin binding domain-containing peptide sequence
HKHLGIENPKH

SEQ ID NO: 2522 - protein, 11 aa, Artificial
  IGFBP-2 heparin binding domain-containing peptide sequence
KRHLGIENPKH

SEQ ID NO: 2523 - protein, 11 aa, Artificial
  IGFBP-2 heparin binding domain-containing peptide sequence
RRHLGIENPKH

SEQ ID NO: 2524 - protein, 11 aa, Artificial
  IGFBP-2 heparin binding domain-containing peptide sequence
HRHLGIENPKH

SEQ ID NO: 2525 - protein, 11 aa, Artificial
  IGFBP-2 heparin binding domain-containing peptide sequence
KHKLGIENPKH

SEQ ID NO: 2526 - protein, 11 aa, Artificial
  IGFBP-2 heparin binding domain-containing peptide sequence
RHKLGIENPKH

SEQ ID NO: 2527 - protein, 11 aa, Artificial
  IGFBP-2 heparin binding domain-containing peptide sequence
HHKLGIENPKH

SEQ ID NO: 2528 - protein, 11 aa, Artificial
  IGFBP-2 heparin binding domain-containing peptide sequence
KKKLGIENPKH

SEQ ID NO: 2529 - protein, 11 aa, Artificial
  IGFBP-2 heparin binding domain-containing peptide sequence
RKKLGIENPKH

SEQ ID NO: 2530 - protein, 11 aa, Artificial
  IGFBP-2 heparin binding domain-containing peptide sequence
HKKLGIENPKH

SEQ ID NO: 2531 - protein, 11 aa, Artificial
  IGFBP-2 heparin binding domain-containing peptide sequence
KRKLGIENPKH

SEQ ID NO: 2532 - protein, 11 aa, Artificial
  IGFBP-2 heparin binding domain-containing peptide sequence
RRKLGIENPKH

SEQ ID NO: 2533 - protein, 11 aa, Artificial
  IGFBP-2 heparin binding domain-containing peptide sequence
HRKLGIENPKH

SEQ ID NO: 2534 - protein, 11 aa, Artificial
  IGFBP-2 heparin binding domain-containing peptide sequence
KHRLGIENPKH

SEQ ID NO: 2535 - protein, 11 aa, Artificial
  IGFBP-2 heparin binding domain-containing peptide sequence
RHRLGIENPKH

SEQ ID NO: 2536 - protein, 11 aa, Artificial
  IGFBP-2 heparin binding domain-containing peptide sequence
HHRLGIENPKH

SEQ ID NO: 2537 - protein, 11 aa, Artificial
  IGFBP-2 heparin binding domain-containing peptide sequence
KKRLGIENPKH

SEQ ID NO: 2538 - protein, 11 aa, Artificial
  IGFBP-2 heparin binding domain-containing peptide sequence
RKRLGIENPKH

SEQ ID NO: 2539 - protein, 11 aa, Artificial
  IGFBP-2 heparin binding domain-containing peptide sequence
HKRLGIENPKH

SEQ ID NO: 2540 - protein, 11 aa, Artificial
  IGFBP-2 heparin binding domain-containing peptide sequence
KRRLGIENPKH

SEQ ID NO: 2541 - protein, 11 aa, Artificial
  IGFBP-2 heparin binding domain-containing peptide sequence
RRRLGIENPKH

SEQ ID NO: 2542 - protein, 11 aa, Artificial
  IGFBP-2 heparin binding domain-containing peptide sequence
HRRLGIENPKH

SEQ ID NO: 2543 - protein, 11 aa, Artificial
  IGFBP-2 heparin binding domain-containing peptide sequence
KHHIGIENPKH

SEQ ID NO: 2544 - protein, 11 aa, Artificial
  IGFBP-2 heparin binding domain-containing peptide sequence
RHHIGIENPKH

SEQ ID NO: 2545 - protein, 11 aa, Artificial
  IGFBP-2 heparin binding domain-containing peptide sequence
HHHIGIENPKH

SEQ ID NO: 2546 - protein, 11 aa, Artificial
  IGFBP-2 heparin binding domain-containing peptide sequence
KKHIGIENPKH

SEQ ID NO: 2547 - protein, 11 aa, Artificial
  IGFBP-2 heparin binding domain-containing peptide sequence
RKHIGIENPKH

SEQ ID NO: 2548 - protein, 11 aa, Artificial
  IGFBP-2 heparin binding domain-containing peptide sequence
HKHIGIENPKH

SEQ ID NO: 2549 - protein, 11 aa, Artificial
  IGFBP-2 heparin binding domain-containing peptide sequence
KRHIGIENPKH

SEQ ID NO: 2550 - protein, 11 aa, Artificial
  IGFBP-2 heparin binding domain-containing peptide sequence
RRHIGIENPKH

SEQ ID NO: 2551 - protein, 11 aa, Artificial
  IGFBP-2 heparin binding domain-containing peptide sequence
HRHIGIENPKH

SEQ ID NO: 2552 - protein, 11 aa, Artificial
  IGFBP-2 heparin binding domain-containing peptide sequence
KHKIGIENPKH

SEQ ID NO: 2553 - protein, 11 aa, Artificial
  IGFBP-2 heparin binding domain-containing peptide sequence
RHKIGIENPKH

SEQ ID NO: 2554 - protein, 11 aa, Artificial
  IGFBP-2 heparin binding domain-containing peptide sequence
HHKIGIENPKH

SEQ ID NO: 2555 - protein, 11 aa, Artificial
  IGFBP-2 heparin binding domain-containing peptide sequence
KKKIGIENPKH

SEQ ID NO: 2556 - protein, 11 aa, Artificial
  IGFBP-2 heparin binding domain-containing peptide sequence
RKKIGIENPKH

SEQ ID NO: 2557 - protein, 11 aa, Artificial
  IGFBP-2 heparin binding domain-containing peptide sequence
HKKIGIENPKH

SEQ ID NO: 2558 - protein, 11 aa, Artificial
  IGFBP-2 heparin binding domain-containing peptide sequence
KRKIGIENPKH

SEQ ID NO: 2559 - protein, 11 aa, Artificial
  IGFBP-2 heparin binding domain-containing peptide sequence
RRKIGIENPKH

SEQ ID NO: 2560 - protein, 11 aa, Artificial
  IGFBP-2 heparin binding domain-containing peptide sequence
HRKIGIENPKH

SEQ ID NO: 2561 - protein, 11 aa, Artificial
  IGFBP-2 heparin binding domain-containing peptide sequence
KHRIGIENPKH

SEQ ID NO: 2562 - protein, 11 aa, Artificial
  IGFBP-2 heparin binding domain-containing peptide sequence
RHRIGIENPKH

SEQ ID NO: 2563 - protein, 11 aa, Artificial
  IGFBP-2 heparin binding domain-containing peptide sequence
HHRIGIENPKH

SEQ ID NO: 2564 - protein, 11 aa, Artificial
  IGFBP-2 heparin binding domain-containing peptide sequence
KKRIGIENPKH

SEQ ID NO: 2565 - protein, 11 aa, Artificial
  IGFBP-2 heparin binding domain-containing peptide sequence
RKRIGIENPKH

SEQ ID NO: 2566 - protein, 11 aa, Artificial
  IGFBP-2 heparin binding domain-containing peptide sequence
HKRIGIENPKH

SEQ ID NO: 2567 - protein, 11 aa, Artificial
  IGFBP-2 heparin binding domain-containing peptide sequence
KRRIGIENPKH

SEQ ID NO: 2568 - protein, 11 aa, Artificial
  IGFBP-2 heparin binding domain-containing peptide sequence
RRRIGIENPKH

SEQ ID NO: 2569 - protein, 11 aa, Artificial
  IGFBP-2 heparin binding domain-containing peptide sequence
HRRIGIENPKH

SEQ ID NO: 2570 - protein, 11 aa, Artificial
  IGFBP-2 heparin binding domain-containing peptide sequence
KHHVGIENPKH

SEQ ID NO: 2571 - protein, 11 aa, Artificial
  IGFBP-2 heparin binding domain-containing peptide sequence
RHHVGIENPKH

SEQ ID NO: 2572 - protein, 11 aa, Artificial
  IGFBP-2 heparin binding domain-containing peptide sequence
HHHVGIENPKH

SEQ ID NO: 2573 - protein, 11 aa, Artificial
  IGFBP-2 heparin binding domain-containing peptide sequence
KKHVGIENPKH

SEQ ID NO: 2574 - protein, 11 aa, Artificial
  IGFBP-2 heparin binding domain-containing peptide sequence
RKHVGIENPKH

SEQ ID NO: 2575 - protein, 11 aa, Artificial
  IGFBP-2 heparin binding domain-containing peptide sequence
HKHVGIENPKH

SEQ ID NO: 2576 - protein, 11 aa, Artificial
  IGFBP-2 heparin binding domain-containing peptide sequence
KRHVGIENPKH

SEQ ID NO: 2577 - protein, 11 aa, Artificial
  IGFBP-2 heparin binding domain-containing peptide sequence
RRHVGIENPKH

SEQ ID NO: 2578 - protein, 11 aa, Artificial
  IGFBP-2 heparin binding domain-containing peptide sequence
HRHVGIENPKH

SEQ ID NO: 2579 - protein, 11 aa, Artificial
  IGFBP-2 heparin binding domain-containing peptide sequence
KHKVGIENPKH

SEQ ID NO: 2580 - protein, 11 aa, Artificial
  IGFBP-2 heparin binding domain-containing peptide sequence
RHKVGIENPKH

SEQ ID NO: 2581 - protein, 11 aa, Artificial
  IGFBP-2 heparin binding domain-containing peptide sequence
HHKVGIENPKH

SEQ ID NO: 2582 - protein, 11 aa, Artificial
  IGFBP-2 heparin binding domain-containing peptide sequence
KKKVGIENPKH

SEQ ID NO: 2583 - protein, 11 aa, Artificial
  IGFBP-2 heparin binding domain-containing peptide sequence
RKKVGIENPKH

SEQ ID NO: 2584 - protein, 11 aa, Artificial
  IGFBP-2 heparin binding domain-containing peptide sequence
HKKVGIENPKH

SEQ ID NO: 2585 - protein, 11 aa, Artificial
  IGFBP-2 heparin binding domain-containing peptide sequence
KRKVGIENPKH

SEQ ID NO: 2586 - protein, 11 aa, Artificial
  IGFBP-2 heparin binding domain-containing peptide sequence
RRKVGIENPKH

SEQ ID NO: 2587 - protein, 11 aa, Artificial
  IGFBP-2 heparin binding domain-containing peptide sequence
HRKVGIENPKH

SEQ ID NO: 2588 - protein, 11 aa, Artificial
  IGFBP-2 heparin binding domain-containing peptide sequence
KHRVGIENPKH

SEQ ID NO: 2589 - protein, 11 aa, Artificial
  IGFBP-2 heparin binding domain-containing peptide sequence
RHRVGIENPKH

SEQ ID NO: 2590 - protein, 11 aa, Artificial
  IGFBP-2 heparin binding domain-containing peptide sequence
HHRVGIENPKH

SEQ ID NO: 2591 - protein, 11 aa, Artificial
  IGFBP-2 heparin binding domain-containing peptide sequence
KKRVGIENPKH

SEQ ID NO: 2592 - protein, 11 aa, Artificial
  IGFBP-2 heparin binding domain-containing peptide sequence
RKRVGIENPKH

SEQ ID NO: 2593 - protein, 11 aa, Artificial
  IGFBP-2 heparin binding domain-containing peptide sequence
HKRVGIENPKH

SEQ ID NO: 2594 - protein, 11 aa, Artificial
  IGFBP-2 heparin binding domain-containing peptide sequence
KRRVGIENPKH

SEQ ID NO: 2595 - protein, 11 aa, Artificial
  IGFBP-2 heparin binding domain-containing peptide sequence
RRRVGIENPKH

SEQ ID NO: 2596 - protein, 11 aa, Artificial
  IGFBP-2 heparin binding domain-containing peptide sequence
HRRVGIENPKH

SEQ ID NO: 2597 - protein, 11 aa, Artificial
  IGFBP-2 heparin binding domain-containing peptide sequence
KHHLGVENPKH

SEQ ID NO: 2598 - protein, 11 aa, Artificial
  IGFBP-2 heparin binding domain-containing peptide sequence
RHHLGVENPKH

SEQ ID NO: 2599 - protein, 11 aa, Artificial
  IGFBP-2 heparin binding domain-containing peptide sequence
HHHLGVENPKH

SEQ ID NO: 2600 - protein, 11 aa, Artificial
  IGFBP-2 heparin binding domain-containing peptide sequence
KKHLGVENPKH

SEQ ID NO: 2601 - protein, 11 aa, Artificial
  IGFBP-2 heparin binding domain-containing peptide sequence
RKHLGVENPKH

SEQ ID NO: 2602 - protein, 11 aa, Artificial
  IGFBP-2 heparin binding domain-containing peptide sequence
HKHLGVENPKH

SEQ ID NO: 2603 - protein, 11 aa, Artificial
  IGFBP-2 heparin binding domain-containing peptide sequence
KRHLGVENPKH

SEQ ID NO: 2604 - protein, 11 aa, Artificial
  IGFBP-2 heparin binding domain-containing peptide sequence
RRHLGVENPKH

SEQ ID NO: 2605 - protein, 11 aa, Artificial
  IGFBP-2 heparin binding domain-containing peptide sequence
HRHLGVENPKH

SEQ ID NO: 2606 - protein, 11 aa, Artificial
  IGFBP-2 heparin binding domain-containing peptide sequence
KHKLGVENPKH

SEQ ID NO: 2607 - protein, 11 aa, Artificial
  IGFBP-2 heparin binding domain-containing peptide sequence
RHKLGVENPKH

SEQ ID NO: 2608 - protein, 11 aa, Artificial
  IGFBP-2 heparin binding domain-containing peptide sequence
HHKLGVENPKH

SEQ ID NO: 2609 - protein, 11 aa, Artificial
  IGFBP-2 heparin binding domain-containing peptide sequence
KKKLGVENPKH

SEQ ID NO: 2610 - protein, 11 aa, Artificial
  IGFBP-2 heparin binding domain-containing peptide sequence
RKKLGVENPKH

SEQ ID NO: 2611 - protein, 11 aa, Artificial
  IGFBP-2 heparin binding domain-containing peptide sequence
HKKLGVENPKH

SEQ ID NO: 2612 - protein, 11 aa, Artificial
  IGFBP-2 heparin binding domain-containing peptide sequence
KRKLGVENPKH

SEQ ID NO: 2613 - protein, 11 aa, Artificial
  IGFBP-2 heparin binding domain-containing peptide sequence
RRKLGVENPKH

SEQ ID NO: 2614 - protein, 11 aa, Artificial
  IGFBP-2 heparin binding domain-containing peptide sequence
HRKLGVENPKH

SEQ ID NO: 2615 - protein, 11 aa, Artificial
  IGFBP-2 heparin binding domain-containing peptide sequence
KHRLGVENPKH

SEQ ID NO: 2616 - protein, 11 aa, Artificial
  IGFBP-2 heparin binding domain-containing peptide sequence
RHRLGVENPKH

SEQ ID NO: 2617 - protein, 11 aa, Artificial
  IGFBP-2 heparin binding domain-containing peptide sequence
HHRLGVENPKH

SEQ ID NO: 2618 - protein, 11 aa, Artificial
  IGFBP-2 heparin binding domain-containing peptide sequence
KKRLGVENPKH

SEQ ID NO: 2619 - protein, 11 aa, Artificial
  IGFBP-2 heparin binding domain-containing peptide sequence
RKRLGVENPKH

SEQ ID NO: 2620 - protein, 11 aa, Artificial
  IGFBP-2 heparin binding domain-containing peptide sequence
HKRLGVENPKH

SEQ ID NO: 2621 - protein, 11 aa, Artificial
  IGFBP-2 heparin binding domain-containing peptide sequence
KRRLGVENPKH

SEQ ID NO: 2622 - protein, 11 aa, Artificial
  IGFBP-2 heparin binding domain-containing peptide sequence
RRRLGVENPKH

SEQ ID NO: 2623 - protein, 11 aa, Artificial
  IGFBP-2 heparin binding domain-containing peptide sequence
HRRLGVENPKH

SEQ ID NO: 2624 - protein, 11 aa, Artificial
  IGFBP-2 heparin binding domain-containing peptide sequence
KHHIGVENPKH

SEQ ID NO: 2625 - protein, 11 aa, Artificial
  IGFBP-2 heparin binding domain-containing peptide sequence
RHHIGVEEPKH

SEQ ID NO: 2626 - protein, 11 aa, Artificial
  IGFBP-2 heparin binding domain-containing peptide sequence
HHHIGVENPKH

SEQ ID NO: 2627 - protein, 11 aa, Artificial
  IGFBP-2 heparin binding domain-containing peptide sequence
KKHIGVENPKH

SEQ ID NO: 2628 - protein, 11 aa, Artificial
  IGFBP-2 heparin binding domain-containing peptide sequence
RKHIGVENPKH

SEQ ID NO: 2629 - protein, 11 aa, Artificial
  IGFBP-2 heparin binding domain-containing peptide sequence
HKHIGVENPKH

SEQ ID NO: 2630 - protein, 11 aa, Artificial
  IGFBP-2 heparin binding domain-containing peptide sequence
KRHIGVENPKH

SEQ ID NO: 2631 - protein, 11 aa, Artificial
  IGFBP-2 heparin binding domain-containing peptide sequence
RRHIGVENPKH

SEQ ID NO: 2632 - protein, 11 aa, Artificial
  IGFBP-2 heparin binding domain-containing peptide sequence
HRHIGVENPKH

SEQ ID NO: 2633 - protein, 11 aa, Artificial
  IGFBP-2 heparin binding domain-containing peptide sequence
KHKIGVENPKH

SEQ ID NO: 2634 - protein, 11 aa, Artificial
  IGFBP-2 heparin binding domain-containing peptide sequence
RHKIGVENPKH

SEQ ID NO: 2635 - protein, 11 aa, Artificial
  IGFBP-2 heparin binding domain-containing peptide sequence
HHKIGVENPKH

SEQ ID NO: 2636 - protein, 11 aa, Artificial
  IGFBP-2 heparin binding domain-containing peptide sequence
KKKIGVENPKH

SEQ ID NO: 2637 - protein, 11 aa, Artificial
  IGFBP-2 heparin binding domain-containing peptide sequence
RKKIGVENPKH

SEQ ID NO: 2638 - protein, 11 aa, Artificial
  IGFBP-2 heparin binding domain-containing peptide sequence
HKKIGVENPKH

SEQ ID NO: 2639 - protein, 11 aa, Artificial
  IGFBP-2 heparin binding domain-containing peptide sequence
KRKIGVENPKH

SEQ ID NO: 2640 - protein, 11 aa, Artificial
  IGFBP-2 heparin binding domain-containing peptide sequence
RRKIGVENPKH

SEQ ID NO: 2641 - protein, 11 aa, Artificial
  IGFBP-2 heparin binding domain-containing peptide sequence
HRKIGVENPKH

SEQ ID NO: 2642 - protein, 11 aa, Artificial
  IGFBP-2 heparin binding domain-containing peptide sequence
KHRIGVENPKH

SEQ ID NO: 2643 - protein, 11 aa, Artificial
  IGFBP-2 heparin binding domain-containing peptide sequence
RHRIGVENPKH

SEQ ID NO: 2644 - protein, 11 aa, Artificial
  IGFBP-2 heparin binding domain-containing peptide sequence
HHRIGVENPKH

SEQ ID NO: 2645 - protein, 11 aa, Artificial
  IGFBP-2 heparin binding domain-containing peptide sequence
KKRIGVENPKH

SEQ ID NO: 2646 - protein, 11 aa, Artificial
  IGFBP-2 heparin binding domain-containing peptide sequence
RKRIGVENPKH

SEQ ID NO: 2647 - protein, 11 aa, Artificial
  IGFBP-2 heparin binding domain-containing peptide sequence
HKRIGVENPKH

SEQ ID NO: 2648 - protein, 11 aa, Artificial
  IGFBP-2 heparin binding domain-containing peptide sequence
KRRIGVENPKH

SEQ ID NO: 2649 - protein, 11 aa, Artificial
  IGFBP-2 heparin binding domain-containing peptide sequence
RRRIGVENPKH

SEQ ID NO: 2650 - protein, 11 aa, Artificial
  IGFBP-2 heparin binding domain-containing peptide sequence
HRRIGVENPKH

SEQ ID NO: 2651 - protein, 11 aa, Artificial
  IGFBP-2 heparin binding domain-containing peptide sequence
KHHVGVENPKH

SEQ ID NO: 2652 - protein, 11 aa, Artificial
  IGFBP-2 heparin binding domain-containing peptide sequence
RHHVGVENPKH

SEQ ID NO: 2653 - protein, 11 aa, Artificial
  IGFBP-2 heparin binding domain-containing peptide sequence
HHHVGVENPKH

SEQ ID NO: 2654 - protein, 11 aa, Artificial
  IGFBP-2 heparin binding domain-containing peptide sequence
KKHVGVENPKH

SEQ ID NO: 2655 - protein, 11 aa, Artificial
  IGFBP-2 heparin binding domain-containing peptide sequence
RKHVGVENPKH

SEQ ID NO: 2656 - protein, 11 aa, Artificial
  IGFBP-2 heparin binding domain-containing peptide sequence
HKHVGVENPKH

SEQ ID NO: 2657 - protein, 11 aa, Artificial
  IGFBP-2 heparin binding domain-containing peptide sequence
KRHVGVENPKH

SEQ ID NO: 2658 - protein, 11 aa, Artificial
  IGFBP-2 heparin binding domain-containing peptide sequence
RRHVGVENPKH

SEQ ID NO: 2659 - protein, 11 aa, Artificial
  IGFBP-2 heparin binding domain-containing peptide sequence
HRHVGVENPKH

SEQ ID NO: 2660 - protein, 11 aa, Artificial
  IGFBP-2 heparin binding domain-containing peptide sequence
KHKVGVENPKH

SEQ ID NO: 2661 - protein, 11 aa, Artificial
  IGFBP-2 heparin binding domain-containing peptide sequence
RHKVGVENPKH

SEQ ID NO: 2662 - protein, 11 aa, Artificial
  IGFBP-2 heparin binding domain-containing peptide sequence
HHKVGVENPKH

SEQ ID NO: 2663 - protein, 11 aa, Artificial
  IGFBP-2 heparin binding domain-containing peptide sequence
KKKVGVENPKH

SEQ ID NO: 2664 - protein, 11 aa, Artificial
  IGFBP-2 heparin binding domain-containing peptide sequence
RKKVGVENPKH

SEQ ID NO: 2665 - protein, 11 aa, Artificial
  IGFBP-2 heparin binding domain-containing peptide sequence
HKKVGVENPKH

SEQ ID NO: 2666 - protein, 11 aa, Artificial
  IGFBP-2 heparin binding domain-containing peptide sequence
KRKVGVENPKH

SEQ ID NO: 2667 - protein, 11 aa, Artificial
  IGFBP-2 heparin binding domain-containing peptide sequence
RRKVGVEEPKH

SEQ ID NO: 2668 - protein, 11 aa, Artificial
  IGFBP-2 heparin binding domain-containing peptide sequence
HRKVGVENPKH

SEQ ID NO: 2669 - protein, 11 aa, Artificial
  IGFBP-2 heparin binding domain-containing peptide sequence
KHRVGVENPKH

SEQ ID NO: 2670 - protein, 11 aa, Artificial
  IGFBP-2 heparin binding domain-containing peptide sequence
RHRVGVENPKH

SEQ ID NO: 2671 - protein, 11 aa, Artificial
  IGFBP-2 heparin binding domain-containing peptide sequence
HHRVGVENPKH

SEQ ID NO: 2672 - protein, 11 aa, Artificial
  IGFBP-2 heparin binding domain-containing peptide sequence
KKRVGVENPKH

SEQ ID NO: 2673 - protein, 11 aa, Artificial
  IGFBP-2 heparin binding domain-containing peptide sequence
RKRVGVENPKH

SEQ ID NO: 2674 - protein, 11 aa, Artificial
  IGFBP-2 heparin binding domain-containing peptide sequence
HKRVGVENPKH

SEQ ID NO: 2675 - protein, 11 aa, Artificial
  IGFBP-2 heparin binding domain-containing peptide sequence
KRRVGVENPKH

SEQ ID NO: 2676 - protein, 11 aa, Artificial
  IGFBP-2 heparin binding domain-containing peptide sequence
RRRVGVENPKH

SEQ ID NO: 2677 - protein, 11 aa, Artificial
  IGFBP-2 heparin binding domain-containing peptide sequence
HRRVGVENPKH

SEQ ID NO: 2678 - protein, 11 aa, Artificial
  IGFBP-2 heparin binding domain-containing peptide sequence
KHHLGLNNPKH

SEQ ID NO: 2679 - protein, 11 aa, Artificial
  IGFBP-2 heparin binding domain-containing peptide sequence
RHHLGLNNPKH

SEQ ID NO: 2680 - protein, 11 aa, Artificial
  IGFBP-2 heparin binding domain-containing peptide sequence
HHHLGLNNPKH

SEQ ID NO: 2681 - protein, 11 aa, Artificial
  IGFBP-2 heparin binding domain-containing peptide sequence
KKHLGLNNPKH

SEQ ID NO: 2682 - protein, 11 aa, Artificial
  IGFBP-2 heparin binding domain-containing peptide sequence
RKHLGLNNPKH

SEQ ID NO: 2683 - protein, 11 aa, Artificial
  IGFBP-2 heparin binding domain-containing peptide sequence
HKHLGLNNPKH

SEQ ID NO: 2684 - protein, 11 aa, Artificial
  IGFBP-2 heparin binding domain-containing peptide sequence
KRHLGLNNPKH

SEQ ID NO: 2685 - protein, 11 aa, Artificial
  IGFBP-2 heparin binding domain-containing peptide sequence
RRHLGLNNPKH

SEQ ID NO: 2686 - protein, 11 aa, Artificial
  IGFBP-2 heparin binding domain-containing peptide sequence
HRHLGLNNPKH

SEQ ID NO: 2687 - protein, 11 aa, Artificial
  IGFBP-2 heparin binding domain-containing peptide sequence
KHKLGLNNPKH

SEQ ID NO: 2688 - protein, 11 aa, Artificial
  IGFBP-2 heparin binding domain-containing peptide sequence
RHKLGLNNPKH

SEQ ID NO: 2689 - protein, 11 aa, Artificial
  IGFBP-2 heparin binding domain-containing peptide sequence
HHKLGLNNPKH

SEQ ID NO: 2690 - protein, 11 aa, Artificial
  IGFBP-2 heparin binding domain-containing peptide sequence
KKKLGLNNPKH

SEQ ID NO: 2691 - protein, 11 aa, Artificial
  IGFBP-2 heparin binding domain-containing peptide sequence
RKKLGLNNPKH

SEQ ID NO: 2692 - protein, 11 aa, Artificial
  IGFBP-2 heparin binding domain-containing peptide sequence
HKKLGLNNPKH

SEQ ID NO: 2693 - protein, 11 aa, Artificial
  IGFBP-2 heparin binding domain-containing peptide sequence
KRKLGLNNPKH

SEQ ID NO: 2694 - protein, 11 aa, Artificial
  IGFBP-2 heparin binding domain-containing peptide sequence
RRKLGLNNPKH

SEQ ID NO: 2695 - protein, 11 aa, Artificial
  IGFBP-2 heparin binding domain-containing peptide sequence
HRKLGLNNPKH

SEQ ID NO: 2696 - protein, 11 aa, Artificial
  IGFBP-2 heparin binding domain-containing peptide sequence
KHRLGLNNPKH

SEQ ID NO: 2697 - protein, 11 aa, Artificial
  IGFBP-2 heparin binding domain-containing peptide sequence
RHRLGLNNPKH

SEQ ID NO: 2698 - protein, 11 aa, Artificial
  IGFBP-2 heparin binding domain-containing peptide sequence
HHRLGLNNPKH

SEQ ID NO: 2699 - protein, 11 aa, Artificial
  IGFBP-2 heparin binding domain-containing peptide sequence
KKRLGLNNPKH

SEQ ID NO: 2700 - protein, 11 aa, Artificial
  IGFBP-2 heparin binding domain-containing peptide sequence
RKRLGLNNPKH

SEQ ID NO: 2701 - protein, 11 aa, Artificial
  IGFBP-2 heparin binding domain-containing peptide sequence
HKRLGLNNPKH

SEQ ID NO: 2702 - protein, 11 aa, Artificial
  IGFBP-2 heparin binding domain-containing peptide sequence
KRRLGLNNPKH

SEQ ID NO: 2703 - protein, 11 aa, Artificial
  IGFBP-2 heparin binding domain-containing peptide sequence
RRRLGLNNPKH

SEQ ID NO: 2704 - protein, 11 aa, Artificial
  IGFBP-2 heparin binding domain-containing peptide sequence
HRRLGLNNPKH

SEQ ID NO: 2705 - protein, 11 aa, Artificial
  IGFBP-2 heparin binding domain-containing peptide sequence
KHHIGLNNPKH

SEQ ID NO: 2706 - protein, 11 aa, Artificial
  IGFBP-2 heparin binding domain-containing peptide sequence
RHHIGLNNPKH

SEQ ID NO: 2707 - protein, 11 aa, Artificial
  IGFBP-2 heparin binding domain-containing peptide sequence
HHHIGLNNPKH

SEQ ID NO: 2708 - protein, 11 aa, Artificial
  IGFBP-2 heparin binding domain-containing peptide sequence
KKHIGLNNPKH

SEQ ID NO: 2709 - protein, 11 aa, Artificial
  IGFBP-2 heparin binding domain-containing peptide sequence
RKHIGLNNPKH

SEQ ID NO: 2710 - protein, 11 aa, Artificial
  IGFBP-2 heparin binding domain-containing peptide sequence
HKHIGLNNPKH

SEQ ID NO: 2711 - protein, 11 aa, Artificial
  IGFBP-2 heparin binding domain-containing peptide sequence
KRHIGLNNPKH

SEQ ID NO: 2712 - protein, 11 aa, Artificial
  IGFBP-2 heparin binding domain-containing peptide sequence
RRHIGLNNPKH

SEQ ID NO: 2713 - protein, 11 aa, Artificial
  IGFBP-2 heparin binding domain-containing peptide sequence
HRHIGLNNPKH

SEQ ID NO: 2714 - protein, 11 aa, Artificial
  IGFBP-2 heparin binding domain-containing peptide sequence
KHKIGLNNPKH

SEQ ID NO: 2715 - protein, 11 aa, Artificial
  IGFBP-2 heparin binding domain-containing peptide sequence
RHKIGLNNPKH

SEQ ID NO: 2716 - protein, 11 aa, Artificial
  IGFBP-2 heparin binding domain-containing peptide sequence
HHKIGLNNPKH

SEQ ID NO: 2717 - protein, 11 aa, Artificial
  IGFBP-2 heparin binding domain-containing peptide sequence
KKKIGLNNPKH

SEQ ID NO: 2718 - protein, 11 aa, Artificial
  IGFBP-2 heparin binding domain-containing peptide sequence
RKKIGLNNPKH

SEQ ID NO: 2719 - protein, 11 aa, Artificial
  IGFBP-2 heparin binding domain-containing peptide sequence
HKKIGLNNPKH

SEQ ID NO: 2720 - protein, 11 aa, Artificial
  IGFBP-2 heparin binding domain-containing peptide sequence
KRKIGLNNPKH

SEQ ID NO: 2721 - protein, 11 aa, Artificial
  IGFBP-2 heparin binding domain-containing peptide sequence
RRKIGLNNPKH

SEQ ID NO: 2722 - protein, 11 aa, Artificial
  IGFBP-2 heparin binding domain-containing peptide sequence
HRKIGLNNPKH

SEQ ID NO: 2723 - protein, 11 aa, Artificial
  IGFBP-2 heparin binding domain-containing peptide sequence
KHRIGLNNPKH

SEQ ID NO: 2724 - protein, 11 aa, Artificial
  IGFBP-2 heparin binding domain-containing peptide sequence
RHRIGLNNPKH

SEQ ID NO: 2725 - protein, 11 aa, Artificial
  IGFBP-2 heparin binding domain-containing peptide sequence
HHRIGLNNPKH

SEQ ID NO: 2726 - protein, 11 aa, Artificial
  IGFBP-2 heparin binding domain-containing peptide sequence
KKRIGLNNPKH

SEQ ID NO: 2727 - protein, 11 aa, Artificial
  IGFBP-2 heparin binding domain-containing peptide sequence
RKRIGLNNPKH

SEQ ID NO: 2728 - protein, 11 aa, Artificial
  IGFBP-2 heparin binding domain-containing peptide sequence
HKRIGLNNPKH

SEQ ID NO: 2729 - protein, 11 aa, Artificial
  IGFBP-2 heparin binding domain-containing peptide sequence
KRRIGLNNPKH

SEQ ID NO: 2730 - protein, 11 aa, Artificial
  IGFBP-2 heparin binding domain-containing peptide sequence
RRRIGLNNPKH

SEQ ID NO: 2731 - protein, 11 aa, Artificial
  IGFBP-2 heparin binding domain-containing peptide sequence
HRRIGLNNPKH

SEQ ID NO: 2732 - protein, 11 aa, Artificial
  IGFBP-2 heparin binding domain-containing peptide sequence
KHHVGLNNPKH

SEQ ID NO: 2733 - protein, 11 aa, Artificial
  IGFBP-2 heparin binding domain-containing peptide sequence
RHHVGLNNPKH

SEQ ID NO: 2734 - protein, 11 aa, Artificial
  IGFBP-2 heparin binding domain-containing peptide sequence
HHHVGLNNPKH

SEQ ID NO: 2735 - protein, 11 aa, Artificial
  IGFBP-2 heparin binding domain-containing peptide sequence
KKHVGLNNPKH

SEQ ID NO: 2736 - protein, 11 aa, Artificial
  IGFBP-2 heparin binding domain-containing peptide sequence
RKHVGLNNPKH

SEQ ID NO: 2737 - protein, 11 aa, Artificial
  IGFBP-2 heparin binding domain-containing peptide sequence
HKHVGLNNPKH

SEQ ID NO: 2738 - protein, 11 aa, Artificial
  IGFBP-2 heparin binding domain-containing peptide sequence
KRHVGLNNPKH

SEQ ID NO: 2739 - protein, 11 aa, Artificial
  IGFBP-2 heparin binding domain-containing peptide sequence
RRHVGLNNPKH

SEQ ID NO: 2740 - protein, 11 aa, Artificial
  IGFBP-2 heparin binding domain-containing peptide sequence
HRHVGLNNPKH

SEQ ID NO: 2741 - protein, 11 aa, Artificial
  IGFBP-2 heparin binding domain-containing peptide sequence
KHKVGLNNPKH

SEQ ID NO: 2742 - protein, 11 aa, Artificial
  IGFBP-2 heparin binding domain-containing peptide sequence
RHKVGLNNPKH

SEQ ID NO: 2743 - protein, 11 aa, Artificial
  IGFBP-2 heparin binding domain-containing peptide sequence
HHKVGLNNPKH

SEQ ID NO: 2744 - protein, 11 aa, Artificial
  IGFBP-2 heparin binding domain-containing peptide sequence
KKKVGLNNPKH

SEQ ID NO: 2745 - protein, 11 aa, Artificial
  IGFBP-2 heparin binding domain-containing peptide sequence
RKKVGLNNPKH

SEQ ID NO: 2746 - protein, 11 aa, Artificial
  IGFBP-2 heparin binding domain-containing peptide sequence
HKKVGLNNPKH

SEQ ID NO: 2747 - protein, 11 aa, Artificial
  IGFBP-2 heparin binding domain-containing peptide sequence
KRKVGLNNPKH

SEQ ID NO: 2748 - protein, 11 aa, Artificial
  IGFBP-2 heparin binding domain-containing peptide sequence
RRKVGLNNPKH

SEQ ID NO: 2749 - protein, 11 aa, Artificial
  IGFBP-2 heparin binding domain-containing peptide sequence
HRKVGLNNPKH

SEQ ID NO: 2750 - protein, 11 aa, Artificial
  IGFBP-2 heparin binding domain-containing peptide sequence
KHRVGLNNPKH

SEQ ID NO: 2751 - protein, 11 aa, Artificial
  IGFBP-2 heparin binding domain-containing peptide sequence
RHRVGLNNPKH

SEQ ID NO: 2752 - protein, 11 aa, Artificial
  IGFBP-2 heparin binding domain-containing peptide sequence
HHRVGLNNPKH

SEQ ID NO: 2753 - protein, 11 aa, Artificial
  IGFBP-2 heparin binding domain-containing peptide sequence
KKRVGLNNPKH

SEQ ID NO: 2754 - protein, 11 aa, Artificial
  IGFBP-2 heparin binding domain-containing peptide sequence
RKRVGLNNPKH

SEQ ID NO: 2755 - protein, 11 aa, Artificial
  IGFBP-2 heparin binding domain-containing peptide sequence
HKRVGLNNPKH

SEQ ID NO: 2756 - protein, 11 aa, Artificial
  IGFBP-2 heparin binding domain-containing peptide sequence
KRRVGLNNPKH

SEQ ID NO: 2757 - protein, 11 aa, Artificial
  IGFBP-2 heparin binding domain-containing peptide sequence
RRRVGLNNPKH

SEQ ID NO: 2758 - protein, 11 aa, Artificial
  IGFBP-2 heparin binding domain-containing peptide sequence
HRRVGLNNPKH

SEQ ID NO: 2759 - protein, 11 aa, Artificial
  IGFBP-2 heparin binding domain-containing peptide sequence
KHHLGINNPKH

SEQ ID NO: 2760 - protein, 11 aa, Artificial
  IGFBP-2 heparin binding domain-containing peptide sequence
RHHLGINNPKH

SEQ ID NO: 2761 - protein, 11 aa, Artificial
  IGFBP-2 heparin binding domain-containing peptide sequence
HHHLGINNPKH

SEQ ID NO: 2762 - protein, 11 aa, Artificial
  IGFBP-2 heparin binding domain-containing peptide sequence
KKHLGINNPKH

SEQ ID NO: 2763 - protein, 11 aa, Artificial
  IGFBP-2 heparin binding domain-containing peptide sequence
RKHLGINNPKH

SEQ ID NO: 2764 - protein, 11 aa, Artificial
  IGFBP-2 heparin binding domain-containing peptide sequence
HKHLGINNPKH

SEQ ID NO: 2765 - protein, 11 aa, Artificial
  IGFBP-2 heparin binding domain-containing peptide sequence
KRHLGINNPKH

SEQ ID NO: 2766 - protein, 11 aa, Artificial
  IGFBP-2 heparin binding domain-containing peptide sequence
RRHLGINNPKH

SEQ ID NO: 2767 - protein, 11 aa, Artificial
  IGFBP-2 heparin binding domain-containing peptide sequence
HRHLGINNPKH

SEQ ID NO: 2768 - protein, 11 aa, Artificial
  IGFBP-2 heparin binding domain-containing peptide sequence
KHKLGINNPKH

SEQ ID NO: 2769 - protein, 11 aa, Artificial
  IGFBP-2 heparin binding domain-containing peptide sequence
RHKLGINNPKH

SEQ ID NO: 2770 - protein, 11 aa, Artificial
  IGFBP-2 heparin binding domain-containing peptide sequence
HHKLGINNPKH

SEQ ID NO: 2771 - protein, 11 aa, Artificial
  IGFBP-2 heparin binding domain-containing peptide sequence
KKKLGINNPKH

SEQ ID NO: 2772 - protein, 11 aa, Artificial
  IGFBP-2 heparin binding domain-containing peptide sequence
RKKLGINNPKH

SEQ ID NO: 2773 - protein, 11 aa, Artificial
  IGFBP-2 heparin binding domain-containing peptide sequence
HKKLGINNPKH

SEQ ID NO: 2774 - protein, 11 aa, Artificial
  IGFBP-2 heparin binding domain-containing peptide sequence
KRKLGINNPKH

SEQ ID NO: 2775 - protein, 11 aa, Artificial
  IGFBP-2 heparin binding domain-containing peptide sequence
RRKLGINNPKH

SEQ ID NO: 2776 - protein, 11 aa, Artificial
  IGFBP-2 heparin binding domain-containing peptide sequence
HRKLGINNPKH

SEQ ID NO: 2777 - protein, 11 aa, Artificial
  IGFBP-2 heparin binding domain-containing peptide sequence
KHRLGINNPKH

SEQ ID NO: 2778 - protein, 11 aa, Artificial
  IGFBP-2 heparin binding domain-containing peptide sequence
RHRLGINNPKH

SEQ ID NO: 2779 - protein, 11 aa, Artificial
  IGFBP-2 heparin binding domain-containing peptide sequence
HHRLGINNPKH

SEQ ID NO: 2780 - protein, 11 aa, Artificial
  IGFBP-2 heparin binding domain-containing peptide sequence
KKRLGINNPKH

SEQ ID NO: 2781 - protein, 11 aa, Artificial
  IGFBP-2 heparin binding domain-containing peptide sequence
RKRLGINNPKH

SEQ ID NO: 2782 - protein, 11 aa, Artificial
  IGFBP-2 heparin binding domain-containing peptide sequence
HKRLGINNPKH

SEQ ID NO: 2783 - protein, 11 aa, Artificial
  IGFBP-2 heparin binding domain-containing peptide sequence
KRRLGINNPKH

SEQ ID NO: 2784 - protein, 11 aa, Artificial
  IGFBP-2 heparin binding domain-containing peptide sequence
RRRLGINNPKH

SEQ ID NO: 2785 - protein, 11 aa, Artificial
  IGFBP-2 heparin binding domain-containing peptide sequence
HRRLGINNPKH

SEQ ID NO: 2786 - protein, 11 aa, Artificial
  IGFBP-2 heparin binding domain-containing peptide sequence
KHHIGIENPKH

SEQ ID NO: 2787 - protein, 11 aa, Artificial
  IGFBP-2 heparin binding domain-containing peptide sequence
RHHIGINNPKH

SEQ ID NO: 2788 - protein, 11 aa, Artificial
  IGFBP-2 heparin binding domain-containing peptide sequence
HHHIGINNPKH

SEQ ID NO: 2789 - protein, 11 aa, Artificial
  IGFBP-2 heparin binding domain-containing peptide sequence
KKHIGINNPKH

SEQ ID NO: 2790 - protein, 11 aa, Artificial
  IGFBP-2 heparin binding domain-containing peptide sequence
RKHIGINNPKH

SEQ ID NO: 2791 - protein, 11 aa, Artificial
  IGFBP-2 heparin binding domain-containing peptide sequence
HKHIGINNPKH

SEQ ID NO: 2792 - protein, 11 aa, Artificial
  IGFBP-2 heparin binding domain-containing peptide sequence
KRHIGINNPKH

SEQ ID NO: 2793 - protein, 11 aa, Artificial
  IGFBP-2 heparin binding domain-containing peptide sequence
RRHIGINNPKH

SEQ ID NO: 2794 - protein, 11 aa, Artificial
  IGFBP-2 heparin binding domain-containing peptide sequence
HRHIGINNPKH

SEQ ID NO: 2795 - protein, 11 aa, Artificial
  IGFBP-2 heparin binding domain-containing peptide sequence
KHKIGINNPKH

SEQ ID NO: 2796 - protein, 11 aa, Artificial
  IGFBP-2 heparin binding domain-containing peptide sequence
RHKIGINNPKH

SEQ ID NO: 2797 - protein, 11 aa, Artificial
  IGFBP-2 heparin binding domain-containing peptide sequence
HHKIGINNPKH

SEQ ID NO: 2798 - protein, 11 aa, Artificial
  IGFBP-2 heparin binding domain-containing peptide sequence
KKKIGINNPKH

SEQ ID NO: 2799 - protein, 11 aa, Artificial
  IGFBP-2 heparin binding domain-containing peptide sequence
RKKIGINNPKH

SEQ ID NO: 2800 - protein, 11 aa, Artificial
  IGFBP-2 heparin binding domain-containing peptide sequence
HKKIGINNPKH

SEQ ID NO: 2801 - protein, 11 aa, Artificial
  IGFBP-2 heparin binding domain-containing peptide sequence
KRKIGINNPKH

SEQ ID NO: 2802 - protein, 11 aa, Artificial
  IGFBP-2 heparin binding domain-containing peptide sequence
RRKIGINNPKH

SEQ ID NO: 2803 - protein, 11 aa, Artificial
  IGFBP-2 heparin binding domain-containing peptide sequence
HRKIGINNPKH

SEQ ID NO: 2804 - protein, 11 aa, Artificial
  IGFBP-2 heparin binding domain-containing peptide sequence
KHRIGINNPKH

SEQ ID NO: 2805 - protein, 11 aa, Artificial
  IGFBP-2 heparin binding domain-containing peptide sequence
RHRIGINNPKH

SEQ ID NO: 2806 - protein, 11 aa, Artificial
  IGFBP-2 heparin binding domain-containing peptide sequence
HHRIGINNPKH

SEQ ID NO: 2807 - protein, 11 aa, Artificial
  IGFBP-2 heparin binding domain-containing peptide sequence
KKRIGINNPKH

SEQ ID NO: 2808 - protein, 11 aa, Artificial
  IGFBP-2 heparin binding domain-containing peptide sequence
RKRIGINNPKH

SEQ ID NO: 2809 - protein, 11 aa, Artificial
  IGFBP-2 heparin binding domain-containing peptide sequence
HKRIGINNPKH

SEQ ID NO: 2810 - protein, 11 aa, Artificial
  IGFBP-2 heparin binding domain-containing peptide sequence
KRRIGINNPKH

SEQ ID NO: 2811 - protein, 11 aa, Artificial
  IGFBP-2 heparin binding domain-containing peptide sequence
RRRIGINNPKH

SEQ ID NO: 2812 - protein, 11 aa, Artificial
  IGFBP-2 heparin binding domain-containing peptide sequence
HRRIGINNPKH

SEQ ID NO: 2813 - protein, 11 aa, Artificial
  IGFBP-2 heparin binding domain-containing peptide sequence
KHHVGINNPKH

SEQ ID NO: 2814 - protein, 11 aa, Artificial
  IGFBP-2 heparin binding domain-containing peptide sequence
RHHVGINNPKH

SEQ ID NO: 2815 - protein, 11 aa, Artificial
  IGFBP-2 heparin binding domain-containing peptide sequence
HHHVGINNPKH

SEQ ID NO: 2816 - protein, 11 aa, Artificial
  IGFBP-2 heparin binding domain-containing peptide sequence
KKHVGINNPKH

SEQ ID NO: 2817 - protein, 11 aa, Artificial
  IGFBP-2 heparin binding domain-containing peptide sequence
RKHVGINNPKH

SEQ ID NO: 2818 - protein, 11 aa, Artificial
  IGFBP-2 heparin binding domain-containing peptide sequence
HKHVGINNPKH

SEQ ID NO: 2819 - protein, 11 aa, Artificial
  IGFBP-2 heparin binding domain-containing peptide sequence
KRHVGINNPKH

SEQ ID NO: 2820 - protein, 11 aa, Artificial
  IGFBP-2 heparin binding domain-containing peptide sequence
RRHVGINNPKH

SEQ ID NO: 2821 - protein, 11 aa, Artificial
  IGFBP-2 heparin binding domain-containing peptide sequence
HRHVGINNPKH

SEQ ID NO: 2822 - protein, 11 aa, Artificial
  IGFBP-2 heparin binding domain-containing peptide sequence
KHKVGINNPKH

SEQ ID NO: 2823 - protein, 11 aa, Artificial
  IGFBP-2 heparin binding domain-containing peptide sequence
RHKVGINNPKH

SEQ ID NO: 2824 - protein, 11 aa, Artificial
  IGFBP-2 heparin binding domain-containing peptide sequence
HHKVGINNPKH

SEQ ID NO: 2825 - protein, 11 aa, Artificial
  IGFBP-2 heparin binding domain-containing peptide sequence
KKKVGINNPKH

SEQ ID NO: 2826 - protein, 11 aa, Artificial
  IGFBP-2 heparin binding domain-containing peptide sequence
RKKVGINNPKH

SEQ ID NO: 2827 - protein, 11 aa, Artificial
  IGFBP-2 heparin binding domain-containing peptide sequence
HKKVGINNPKH

SEQ ID NO: 2828 - protein, 11 aa, Artificial
  IGFBP-2 heparin binding domain-containing peptide sequence
KRKVGINNPKH

SEQ ID NO: 2829 - protein, 11 aa, Artificial
  IGFBP-2 heparin binding domain-containing peptide sequence
RRKVGINNPKH

SEQ ID NO: 2830 - protein, 11 aa, Artificial
  IGFBP-2 heparin binding domain-containing peptide sequence
HRKVGINNPKH

SEQ ID NO: 2831 - protein, 11 aa, Artificial
  IGFBP-2 heparin binding domain-containing peptide sequence
KHRVGINNPKH

SEQ ID NO: 2832 - protein, 11 aa, Artificial
  IGFBP-2 heparin binding domain-containing peptide sequence
RHRVGINNPKH

SEQ ID NO: 2833 - protein, 11 aa, Artificial
  IGFBP-2 heparin binding domain-containing peptide sequence
HHRVGINNPKH

SEQ ID NO: 2834 - protein, 11 aa, Artificial
  IGFBP-2 heparin binding domain-containing peptide sequence
KKRVGINNPKH

SEQ ID NO: 2835 - protein, 11 aa, Artificial
  IGFBP-2 heparin binding domain-containing peptide sequence
RKRVGINNPKH

SEQ ID NO: 2836 - protein, 11 aa, Artificial
  IGFBP-2 heparin binding domain-containing peptide sequence
HKRVGINNPKH

SEQ ID NO: 2837 - protein, 11 aa, Artificial
  IGFBP-2 heparin binding domain-containing peptide sequence
KRRVGINNPKH

SEQ ID NO: 2838 - protein, 11 aa, Artificial
  IGFBP-2 heparin binding domain-containing peptide sequence
RRRVGINNPKH

SEQ ID NO: 2839 - protein, 11 aa, Artificial
  IGFBP-2 heparin binding domain-containing peptide sequence
HRRVGINNPKH

SEQ ID NO: 2840 - protein, 11 aa, Artificial
  IGFBP-2 heparin binding domain-containing peptide sequence
KHHLGVNNPKH

SEQ ID NO: 2841 - protein, 11 aa, Artificial
  IGFBP-2 heparin binding domain-containing peptide sequence
RHHLGVNNPKH

SEQ ID NO: 2842 - protein, 11 aa, Artificial
  IGFBP-2 heparin binding domain-containing peptide sequence
HHHLGVNNPKH

SEQ ID NO: 2843 - protein, 11 aa, Artificial
  IGFBP-2 heparin binding domain-containing peptide sequence
KKHLGVNNPKH

SEQ ID NO: 2844 - protein, 11 aa, Artificial
  IGFBP-2 heparin binding domain-containing peptide sequence
RKHLGVNNPKH

SEQ ID NO: 2845 - protein, 11 aa, Artificial
  IGFBP-2 heparin binding domain-containing peptide sequence
HKHLGVNNPKH

SEQ ID NO: 2846 - protein, 11 aa, Artificial
  IGFBP-2 heparin binding domain-containing peptide sequence
KRHLGVNNPKH

SEQ ID NO: 2847 - protein, 11 aa, Artificial
  IGFBP-2 heparin binding domain-containing peptide sequence
RRHLGVNNPKH

SEQ ID NO: 2848 - protein, 11 aa, Artificial
  IGFBP-2 heparin binding domain-containing peptide sequence
HRHLGVNNPKH

SEQ ID NO: 2849 - protein, 11 aa, Artificial
  IGFBP-2 heparin binding domain-containing peptide sequence
KHKLGVNNPKH

SEQ ID NO: 2850 - protein, 11 aa, Artificial
  IGFBP-2 heparin binding domain-containing peptide sequence
RHKLGVNNPKH

SEQ ID NO: 2851 - protein, 11 aa, Artificial
  IGFBP-2 heparin binding domain-containing peptide sequence
HHKLGVNNPKH

SEQ ID NO: 2852 - protein, 11 aa, Artificial
  IGFBP-2 heparin binding domain-containing peptide sequence
KKKLGVNNPKH

SEQ ID NO: 2853 - protein, 11 aa, Artificial
  IGFBP-2 heparin binding domain-containing peptide sequence
RKKLGVNNPKH

SEQ ID NO: 2854 - protein, 11 aa, Artificial
  IGFBP-2 heparin binding domain-containing peptide sequence
HKKLGVNNPKH

SEQ ID NO: 2855 - protein, 11 aa, Artificial
  IGFBP-2 heparin binding domain-containing peptide sequence
KRKLGVNNPKH

SEQ ID NO: 2856 - protein, 11 aa, Artificial
  IGFBP-2 heparin binding domain-containing peptide sequence
RRKLGVNNPKH

SEQ ID NO: 2857 - protein, 11 aa, Artificial
  IGFBP-2 heparin binding domain-containing peptide sequence
HRKLGVNNPKH

SEQ ID NO: 2858 - protein, 11 aa, Artificial
  IGFBP-2 heparin binding domain-containing peptide sequence
KHRLGVNNPKH

SEQ ID NO: 2859 - protein, 11 aa, Artificial
  IGFBP-2 heparin binding domain-containing peptide sequence
RHRLGVNNPKH

SEQ ID NO: 2860 - protein, 11 aa, Artificial
  IGFBP-2 heparin binding domain-containing peptide sequence
HHRLGVNNPKH

SEQ ID NO: 2861 - protein, 11 aa, Artificial
  IGFBP-2 heparin binding domain-containing peptide sequence
KKRLGVNNPKH

SEQ ID NO: 2862 - protein, 11 aa, Artificial
  IGFBP-2 heparin binding domain-containing peptide sequence
RKRLGVNNPKH

SEQ ID NO: 2863 - protein, 11 aa, Artificial
  IGFBP-2 heparin binding domain-containing peptide sequence
HKRLGVNNPKH

SEQ ID NO: 2864 - protein, 11 aa, Artificial
  IGFBP-2 heparin binding domain-containing peptide sequence
KRRLGVNNPKH

SEQ ID NO: 2865 - protein, 11 aa, Artificial
  IGFBP-2 heparin binding domain-containing peptide sequence
RRRLGVNNPKH

SEQ ID NO: 2866 - protein, 11 aa, Artificial
  IGFBP-2 heparin binding domain-containing peptide sequence
HRRLGVNNPKH

SEQ ID NO: 2867 - protein, 11 aa, Artificial
  IGFBP-2 heparin binding domain-containing peptide sequence
KHHIGVNNPKH

SEQ ID NO: 2868 - protein, 11 aa, Artificial
  IGFBP-2 heparin binding domain-containing peptide sequence
RHHIGVNNPKH

SEQ ID NO: 2869 - protein, 11 aa, Artificial
  IGFBP-2 heparin binding domain-containing peptide sequence
HHHIGVNNPKH

SEQ ID NO: 2870 - protein, 11 aa, Artificial
  IGFBP-2 heparin binding domain-containing peptide sequence
KKHIGVNNPKH

SEQ ID NO: 2871 - protein, 11 aa, Artificial
  IGFBP-2 heparin binding domain-containing peptide sequence
RKHIGVNNPKH

SEQ ID NO: 2872 - protein, 11 aa, Artificial
  IGFBP-2 heparin binding domain-containing peptide sequence
HKHIGVNNPKH

SEQ ID NO: 2873 - protein, 11 aa, Artificial
  IGFBP-2 heparin binding domain-containing peptide sequence
KRHIGVNNPKH

SEQ ID NO: 2874 - protein, 11 aa, Artificial
  IGFBP-2 heparin binding domain-containing peptide sequence
RRHIGVNNPKH

SEQ ID NO: 2875 - protein, 11 aa, Artificial
  IGFBP-2 heparin binding domain-containing peptide sequence
HRHIGVNNPKH

SEQ ID NO: 2876 - protein, 11 aa, Artificial
  IGFBP-2 heparin binding domain-containing peptide sequence
KHKIGVNNPKH

SEQ ID NO: 2877 - protein, 11 aa, Artificial
  IGFBP-2 heparin binding domain-containing peptide sequence
RHKIGVNNPKH

SEQ ID NO: 2878 - protein, 11 aa, Artificial
  IGFBP-2 heparin binding domain-containing peptide sequence
HHKIGVNNPKH

SEQ ID NO: 2879 - protein, 11 aa, Artificial
  IGFBP-2 heparin binding domain-containing peptide sequence
KKKIGVNNPKH

SEQ ID NO: 2880 - protein, 11 aa, Artificial
  IGFBP-2 heparin binding domain-containing peptide sequence
RKKIGVNNPKH

SEQ ID NO: 2881 - protein, 11 aa, Artificial
  IGFBP-2 heparin binding domain-containing peptide sequence
HKKIGVNNPKH

SEQ ID NO: 2882 - protein, 11 aa, Artificial
  IGFBP-2 heparin binding domain-containing peptide sequence
KRKIGVNNPKH

SEQ ID NO: 2883 - protein, 11 aa, Artificial
  IGFBP-2 heparin binding domain-containing peptide sequence
RRKIGVNNPKH

SEQ ID NO: 2884 - protein, 11 aa, Artificial
  IGFBP-2 heparin binding domain-containing peptide sequence
HRKIGVNNPKH

SEQ ID NO: 2885 - protein, 11 aa, Artificial
  IGFBP-2 heparin binding domain-containing peptide sequence
KHRIGVNNPKH

SEQ ID NO: 2886 - protein, 11 aa, Artificial
  IGFBP-2 heparin binding domain-containing peptide sequence
RHRIGVNNPKH

SEQ ID NO: 2887 - protein, 11 aa, Artificial
  IGFBP-2 heparin binding domain-containing peptide sequence
HHRIGVNNPKH

SEQ ID NO: 2888 - protein, 11 aa, Artificial
  IGFBP-2 heparin binding domain-containing peptide sequence
KKRIGVNNPKH

SEQ ID NO: 2889 - protein, 11 aa, Artificial
  IGFBP-2 heparin binding domain-containing peptide sequence
RKRIGVNNPKH

SEQ ID NO: 2890 - protein, 11 aa, Artificial
  IGFBP-2 heparin binding domain-containing peptide sequence
HKRIGVNNPKH

SEQ ID NO: 2891 - protein, 11 aa, Artificial
  IGFBP-2 heparin binding domain-containing peptide sequence
KRRIGVNNPKH

SEQ ID NO: 2892 - protein, 11 aa, Artificial
  IGFBP-2 heparin binding domain-containing peptide sequence
RRRIGVNNPKH

SEQ ID NO: 2893 - protein, 11 aa, Artificial
  IGFBP-2 heparin binding domain-containing peptide sequence
HRRIGVNNPKH

SEQ ID NO: 2894 - protein, 11 aa, Artificial
  IGFBP-2 heparin binding domain-containing peptide sequence
KHHVGVNNPKH

SEQ ID NO: 2895 - protein, 11 aa, Artificial
  IGFBP-2 heparin binding domain-containing peptide sequence
RHHVGVNNPKH

SEQ ID NO: 2896 - protein, 11 aa, Artificial
  IGFBP-2 heparin binding domain-containing peptide sequence
HHHVGVNNPKH

SEQ ID NO: 2897 - protein, 11 aa, Artificial
  IGFBP-2 heparin binding domain-containing peptide sequence
KKHVGVNNPKH

SEQ ID NO: 2898 - protein, 11 aa, Artificial
  IGFBP-2 heparin binding domain-containing peptide sequence
RKHVGVNNPKH

SEQ ID NO: 2899 - protein, 11 aa, Artificial
  IGFBP-2 heparin binding domain-containing peptide sequence
HKHVGVNNPKH

SEQ ID NO: 2900 - protein, 11 aa, Artificial
  IGFBP-2 heparin binding domain-containing peptide sequence
KRHVGVNNPKH

SEQ ID NO: 2901 - protein, 11 aa, Artificial
  IGFBP-2 heparin binding domain-containing peptide sequence
RRHVGVNNPKH

SEQ ID NO: 2902 - protein, 11 aa, Artificial
  IGFBP-2 heparin binding domain-containing peptide sequence
HRHVGVNNPKH

SEQ ID NO: 2903 - protein, 11 aa, Artificial
  IGFBP-2 heparin binding domain-containing peptide sequence
KHKVGVNNPKH

SEQ ID NO: 2904 - protein, 11 aa, Artificial
  IGFBP-2 heparin binding domain-containing peptide sequence
RHKVGVNNPKH

SEQ ID NO: 2905 - protein, 11 aa, Artificial
  IGFBP-2 heparin binding domain-containing peptide sequence
HHKVGVNNPKH

SEQ ID NO: 2906 - protein, 11 aa, Artificial
  IGFBP-2 heparin binding domain-containing peptide sequence
KKKVGVNNPKH

SEQ ID NO: 2907 - protein, 11 aa, Artificial
  IGFBP-2 heparin binding domain-containing peptide sequence
RKKVGVNNPKH

SEQ ID NO: 2908 - protein, 11 aa, Artificial
  IGFBP-2 heparin binding domain-containing peptide sequence
HKKVGVNNPKH

SEQ ID NO: 2909 - protein, 11 aa, Artificial
  IGFBP-2 heparin binding domain-containing peptide sequence
KRKVGVNNPKH

SEQ ID NO: 2910 - protein, 11 aa, Artificial
  IGFBP-2 heparin binding domain-containing peptide sequence
RRKVGVNNPKH

SEQ ID NO: 2911 - protein, 11 aa, Artificial
  IGFBP-2 heparin binding domain-containing peptide sequence
HRKVGVNNPKH

SEQ ID NO: 2912 - protein, 11 aa, Artificial
  IGFBP-2 heparin binding domain-containing peptide sequence
KHRVGVNNPKH

SEQ ID NO: 2913 - protein, 11 aa, Artificial
  IGFBP-2 heparin binding domain-containing peptide sequence
RHRVGVNNPKH

SEQ ID NO: 2914 - protein, 11 aa, Artificial
  IGFBP-2 heparin binding domain-containing peptide sequence
HHRVGVNNPKH

SEQ ID NO: 2915 - protein, 11 aa, Artificial
  IGFBP-2 heparin binding domain-containing peptide sequence
KKRVGVNNPKH

SEQ ID NO: 2916 - protein, 11 aa, Artificial
  IGFBP-2 heparin binding domain-containing peptide sequence
RKRVGVNNPKH

SEQ ID NO: 2917 - protein, 11 aa, Artificial
  IGFBP-2 heparin binding domain-containing peptide sequence
HKRVGVNNPKH

SEQ ID NO: 2918 - protein, 11 aa, Artificial
  IGFBP-2 heparin binding domain-containing peptide sequence
KRRVGVNNPKH

SEQ ID NO: 2919 - protein, 11 aa, Artificial
  IGFBP-2 heparin binding domain-containing peptide sequence
RRRVGVNNPKH

SEQ ID NO: 2920 - protein, 11 aa, Artificial
  IGFBP-2 heparin binding domain-containing peptide sequence
HRRVGVNNPKH

SEQ ID NO: 2921 - protein, 11 aa, Artificial
  IGFBP-2 heparin binding domain-containing peptide sequence
KHHLGLEEPRK

SEQ ID NO: 2922 - protein, 11 aa, Artificial
  IGFBP-2 heparin binding domain-containing peptide sequence
RHHLGLEEPRK

SEQ ID NO: 2923 - protein, 11 aa, Artificial
  IGFBP-2 heparin binding domain-containing peptide sequence
HHHLGLEEPRK

SEQ ID NO: 2924 - protein, 11 aa, Artificial
  IGFBP-2 heparin binding domain-containing peptide sequence
KKHLGLEEPRK

SEQ ID NO: 2925 - protein, 11 aa, Artificial
  IGFBP-2 heparin binding domain-containing peptide sequence
RKHLGLEEPRK

SEQ ID NO: 2926 - protein, 11 aa, Artificial
  IGFBP-2 heparin binding domain-containing peptide sequence
HKHLGLEEPRK

SEQ ID NO: 2927 - protein, 11 aa, Artificial
  IGFBP-2 heparin binding domain-containing peptide sequence
KRHLGLEEPRK

SEQ ID NO: 2928 - protein, 11 aa, Artificial
  IGFBP-2 heparin binding domain-containing peptide sequence
RRHLGLEEPRK

SEQ ID NO: 2929 - protein, 11 aa, Artificial
  IGFBP-2 heparin binding domain-containing peptide sequence
HRHLGLEEPRK

SEQ ID NO: 2930 - protein, 11 aa, Artificial
  IGFBP-2 heparin binding domain-containing peptide sequence
KHKLGLEEPRK

SEQ ID NO: 2931 - protein, 11 aa, Artificial
  IGFBP-2 heparin binding domain-containing peptide sequence
RHKLGLEEPRK

SEQ ID NO: 2932 - protein, 11 aa, Artificial
  IGFBP-2 heparin binding domain-containing peptide sequence
HHKLGLEEPRK

SEQ ID NO: 2933 - protein, 11 aa, Artificial
  IGFBP-2 heparin binding domain-containing peptide sequence
KKKLGLEEPRK

SEQ ID NO: 2934 - protein, 11 aa, Artificial
  IGFBP-2 heparin binding domain-containing peptide sequence
RKKLGLEEPRK

SEQ ID NO: 2935 - protein, 11 aa, Artificial
  IGFBP-2 heparin binding domain-containing peptide sequence
HKKLGLEEPRK

SEQ ID NO: 2936 - protein, 11 aa, Artificial
  IGFBP-2 heparin binding domain-containing peptide sequence
KRKLGLEEPRK

SEQ ID NO: 2937 - protein, 11 aa, Artificial
  IGFBP-2 heparin binding domain-containing peptide sequence
RRKLGLEEPRK

SEQ ID NO: 2938 - protein, 11 aa, Artificial
  IGFBP-2 heparin binding domain-containing peptide sequence
HRKLGLEEPRK

SEQ ID NO: 2939 - protein, 11 aa, Artificial
  IGFBP-2 heparin binding domain-containing peptide sequence
KHRLGLEEPRK

SEQ ID NO: 2940 - protein, 11 aa, Artificial
  IGFBP-2 heparin binding domain-containing peptide sequence
RHRLGLEEPRK

SEQ ID NO: 2941 - protein, 11 aa, Artificial
  IGFBP-2 heparin binding domain-containing peptide sequence
HHRLGLEEPRK

SEQ ID NO: 2942 - protein, 11 aa, Artificial
  IGFBP-2 heparin binding domain-containing peptide sequence
KKRLGLEEPRK

SEQ ID NO: 2943 - protein, 11 aa, Artificial
  IGFBP-2 heparin binding domain-containing peptide sequence
RKRLGLEEPRK

SEQ ID NO: 2944 - protein, 11 aa, Artificial
  IGFBP-2 heparin binding domain-containing peptide sequence
HKRLGLEEPRK

SEQ ID NO: 2945 - protein, 11 aa, Artificial
  IGFBP-2 heparin binding domain-containing peptide sequence
KRRLGLEEPRK

SEQ ID NO: 2946 - protein, 11 aa, Artificial
  IGFBP-2 heparin binding domain-containing peptide sequence
RRRLGLEEPRK

SEQ ID NO: 2947 - protein, 11 aa, Artificial
  IGFBP-2 heparin binding domain-containing peptide sequence
HRRLGLEEPRK

SEQ ID NO: 2948 - protein, 11 aa, Artificial
  IGFBP-2 heparin binding domain-containing peptide sequence
KHHIGLEEPRK

SEQ ID NO: 2949 - protein, 11 aa, Artificial
  IGFBP-2 heparin binding domain-containing peptide sequence
RHHIGLEEPRK

SEQ ID NO: 2950 - protein, 11 aa, Artificial
  IGFBP-2 heparin binding domain-containing peptide sequence
HHHIGLEEPRK

SEQ ID NO: 2951 - protein, 11 aa, Artificial
  IGFBP-2 heparin binding domain-containing peptide sequence
KKHIGLEEPRK

SEQ ID NO: 2952 - protein, 11 aa, Artificial
  IGFBP-2 heparin binding domain-containing peptide sequence
RKHIGLEEPRK

SEQ ID NO: 2953 - protein, 11 aa, Artificial
  IGFBP-2 heparin binding domain-containing peptide sequence
HKHIGLEEPRK

SEQ ID NO: 2954 - protein, 11 aa, Artificial
  IGFBP-2 heparin binding domain-containing peptide sequence
KRHIGLEEPRK

SEQ ID NO: 2955 - protein, 11 aa, Artificial
  IGFBP-2 heparin binding domain-containing peptide sequence
RRHIGLEEPRK

SEQ ID NO: 2956 - protein, 11 aa, Artificial
  IGFBP-2 heparin binding domain-containing peptide sequence
HRHIGLEEPRK

SEQ ID NO: 2957 - protein, 11 aa, Artificial
  IGFBP-2 heparin binding domain-containing peptide sequence
KHKIGLEEPRK

SEQ ID NO: 2958 - protein, 11 aa, Artificial
  IGFBP-2 heparin binding domain-containing peptide sequence
RHKIGLEEPRK

SEQ ID NO: 2959 - protein, 11 aa, Artificial
  IGFBP-2 heparin binding domain-containing peptide sequence
HHKIGLEEPRK

SEQ ID NO: 2960 - protein, 11 aa, Artificial
  IGFBP-2 heparin binding domain-containing peptide sequence
KKKIGLEEPRK

SEQ ID NO: 2961 - protein, 11 aa, Artificial
  IGFBP-2 heparin binding domain-containing peptide sequence
RKKIGLEEPRK

SEQ ID NO: 2962 - protein, 11 aa, Artificial
  IGFBP-2 heparin binding domain-containing peptide sequence
HKKIGLEEPRK

SEQ ID NO: 2963 - protein, 11 aa, Artificial
  IGFBP-2 heparin binding domain-containing peptide sequence
KRKIGLEEPRK

SEQ ID NO: 2964 - protein, 11 aa, Artificial
  IGFBP-2 heparin binding domain-containing peptide sequence
RRKIGLEEPRK

SEQ ID NO: 2965 - protein, 11 aa, Artificial
  IGFBP-2 heparin binding domain-containing peptide sequence
HRKIGLEEPRK

SEQ ID NO: 2966 - protein, 11 aa, Artificial
  IGFBP-2 heparin binding domain-containing peptide sequence
KHRIGLEEPRK

SEQ ID NO: 2967 - protein, 11 aa, Artificial
  IGFBP-2 heparin binding domain-containing peptide sequence
RHRIGLEEPRK

SEQ ID NO: 2968 - protein, 11 aa, Artificial
  IGFBP-2 heparin binding domain-containing peptide sequence
HHRIGLEEPRK

SEQ ID NO: 2969 - protein, 11 aa, Artificial
  IGFBP-2 heparin binding domain-containing peptide sequence
KKRIGLEEPRK

SEQ ID NO: 2970 - protein, 11 aa, Artificial
  IGFBP-2 heparin binding domain-containing peptide sequence
RKRIGLEEPRK

SEQ ID NO: 2971 - protein, 11 aa, Artificial
  IGFBP-2 heparin binding domain-containing peptide sequence
HKRIGLEEPRK

SEQ ID NO: 2972 - protein, 11 aa, Artificial
  IGFBP-2 heparin binding domain-containing peptide sequence
KRRIGLEEPRK

SEQ ID NO: 2973 - protein, 11 aa, Artificial
  IGFBP-2 heparin binding domain-containing peptide sequence
RRRIGLEEPRK

SEQ ID NO: 2974 - protein, 11 aa, Artificial
  IGFBP-2 heparin binding domain-containing peptide sequence
HRRIGLEEPRK

SEQ ID NO: 2975 - protein, 11 aa, Artificial
  IGFBP-2 heparin binding domain-containing peptide sequence
KHHVGLEEPRK

SEQ ID NO: 2976 - protein, 11 aa, Artificial
  IGFBP-2 heparin binding domain-containing peptide sequence
RHHVGLEEPRK

SEQ ID NO: 2977 - protein, 11 aa, Artificial
  IGFBP-2 heparin binding domain-containing peptide sequence
HHHVGLEEPRK

SEQ ID NO: 2978 - protein, 11 aa, Artificial
  IGFBP-2 heparin binding domain-containing peptide sequence
KKHVGLEEPRK

SEQ ID NO: 2979 - protein, 11 aa, Artificial
  IGFBP-2 heparin binding domain-containing peptide sequence
RKHVGLEEPRK

SEQ ID NO: 2980 - protein, 11 aa, Artificial
  IGFBP-2 heparin binding domain-containing peptide sequence
HKHVGLEEPRK

SEQ ID NO: 2981 - protein, 11 aa, Artificial
  IGFBP-2 heparin binding domain-containing peptide sequence
KRHVGLEEPRK

SEQ ID NO: 2982 - protein, 11 aa, Artificial
  IGFBP-2 heparin binding domain-containing peptide sequence
RRHVGLEEPRK

SEQ ID NO: 2983 - protein, 11 aa, Artificial
  IGFBP-2 heparin binding domain-containing peptide sequence
HRHVGLEEPRK

SEQ ID NO: 2984 - protein, 11 aa, Artificial
  IGFBP-2 heparin binding domain-containing peptide sequence
KHKVGLEEPRK

SEQ ID NO: 2985 - protein, 11 aa, Artificial
  IGFBP-2 heparin binding domain-containing peptide sequence
RHKVGLEEPRK

SEQ ID NO: 2986 - protein, 11 aa, Artificial
  IGFBP-2 heparin binding domain-containing peptide sequence
HHKVGLEEPRK

SEQ ID NO: 2987 - protein, 11 aa, Artificial
  IGFBP-2 heparin binding domain-containing peptide sequence
KKKVGLEEPRK

SEQ ID NO: 2988 - protein, 11 aa, Artificial
  IGFBP-2 heparin binding domain-containing peptide sequence
RKKVGLEEPRK

SEQ ID NO: 2989 - protein, 11 aa, Artificial
  IGFBP-2 heparin binding domain-containing peptide sequence
HKKVGLEEPRK

SEQ ID NO: 2990 - protein, 11 aa, Artificial
  IGFBP-2 heparin binding domain-containing peptide sequence
KRKVGLEEPRK

SEQ ID NO: 2991 - protein, 11 aa, Artificial
  IGFBP-2 heparin binding domain-containing peptide sequence
RRKVGLEEPRK

SEQ ID NO: 2992 - protein, 11 aa, Artificial
  IGFBP-2 heparin binding domain-containing peptide sequence
HRKVGLEEPRK

SEQ ID NO: 2993 - protein, 11 aa, Artificial
  IGFBP-2 heparin binding domain-containing peptide sequence
KHRVGLEEPRK

SEQ ID NO: 2994 - protein, 11 aa, Artificial
  IGFBP-2 heparin binding domain-containing peptide sequence
RHRVGLEEPRK

SEQ ID NO: 2995 - protein, 11 aa, Artificial
  IGFBP-2 heparin binding domain-containing peptide sequence
HHRVGLEEPRK

SEQ ID NO: 2996 - protein, 11 aa, Artificial
  IGFBP-2 heparin binding domain-containing peptide sequence
KKRVGLEEPRK

SEQ ID NO: 2997 - protein, 11 aa, Artificial
  IGFBP-2 heparin binding domain-containing peptide sequence
RKRVGLEEPRK

SEQ ID NO: 2998 - protein, 11 aa, Artificial
  IGFBP-2 heparin binding domain-containing peptide sequence
HKRVGLEEPRK

SEQ ID NO: 2999 - protein, 11 aa, Artificial
  IGFBP-2 heparin binding domain-containing peptide sequence
KRRVGLEEPRK

SEQ ID NO: 3000 - protein, 11 aa, Artificial
  IGFBP-2 heparin binding domain-containing peptide sequence
RRRVGLEEPRK

SEQ ID NO: 3001 - protein, 11 aa, Artificial
  IGFBP-2 heparin binding domain-containing peptide sequence
HRRVGLEEPRK

SEQ ID NO: 3002 - protein, 11 aa, Artificial
  IGFBP-2 heparin binding domain-containing peptide sequence
KHHLGIEEPRK

SEQ ID NO: 3003 - protein, 11 aa, Artificial
  IGFBP-2 heparin binding domain-containing peptide sequence
RHHLGIEEPRK

SEQ ID NO: 3004 - protein, 11 aa, Artificial
  IGFBP-2 heparin binding domain-containing peptide sequence
HHHLGIEEPRK

SEQ ID NO: 3005 - protein, 11 aa, Artificial
  IGFBP-2 heparin binding domain-containing peptide sequence
KKHLGIEEPRK

SEQ ID NO: 3006 - protein, 11 aa, Artificial
  IGFBP-2 heparin binding domain-containing peptide sequence
RKHLGIEEPRK

SEQ ID NO: 3007 - protein, 11 aa, Artificial
  IGFBP-2 heparin binding domain-containing peptide sequence
HKHLGIEEPRK

SEQ ID NO: 3008 - protein, 11 aa, Artificial
  IGFBP-2 heparin binding domain-containing peptide sequence
KRHLGIEEPRK

SEQ ID NO: 3009 - protein, 11 aa, Artificial
  IGFBP-2 heparin binding domain-containing peptide sequence
RRHLGIEEPRK

SEQ ID NO: 3010 - protein, 11 aa, Artificial
  IGFBP-2 heparin binding domain-containing peptide sequence
HRHLGIEEPRK

SEQ ID NO: 3011 - protein, 11 aa, Artificial
  IGFBP-2 heparin binding domain-containing peptide sequence
KHKLGIEEPRK

SEQ ID NO: 3012 - protein, 11 aa, Artificial
  IGFBP-2 heparin binding domain-containing peptide sequence
RHKLGIEEPRK

SEQ ID NO: 3013 - protein, 11 aa, Artificial
  IGFBP-2 heparin binding domain-containing peptide sequence
HHKLGIEEPRK

SEQ ID NO: 3014 - protein, 11 aa, Artificial
  IGFBP-2 heparin binding domain-containing peptide sequence
KKKLGIEEPRK

SEQ ID NO: 3015 - protein, 11 aa, Artificial
  IGFBP-2 heparin binding domain-containing peptide sequence
RKKLGIEEPRK

SEQ ID NO: 3016 - protein, 11 aa, Artificial
  IGFBP-2 heparin binding domain-containing peptide sequence
HKKLGIEEPRK

SEQ ID NO: 3017 - protein, 11 aa, Artificial
  IGFBP-2 heparin binding domain-containing peptide sequence
KRKLGIEEPRK

SEQ ID NO: 3018 - protein, 11 aa, Artificial
  IGFBP-2 heparin binding domain-containing peptide sequence
RRKLGIEEPRK

SEQ ID NO: 3019 - protein, 11 aa, Artificial
  IGFBP-2 heparin binding domain-containing peptide sequence
HRKLGIEEPRK

SEQ ID NO: 3020 - protein, 11 aa, Artificial
  IGFBP-2 heparin binding domain-containing peptide sequence
KHRLGIEEPRK

SEQ ID NO: 3021 - protein, 11 aa, Artificial
  IGFBP-2 heparin binding domain-containing peptide sequence
RHRLGIEEPRK

SEQ ID NO: 3022 - protein, 11 aa, Artificial
  IGFBP-2 heparin binding domain-containing peptide sequence
HHRLGIEEPRK

SEQ ID NO: 3023 - protein, 11 aa, Artificial
  IGFBP-2 heparin binding domain-containing peptide sequence
KKRLGIEEPRK

SEQ ID NO: 3024 - protein, 11 aa, Artificial
  IGFBP-2 heparin binding domain-containing peptide sequence
RKRLGIEEPRK

SEQ ID NO: 3025 - protein, 11 aa, Artificial
  IGFBP-2 heparin binding domain-containing peptide sequence
HKRLGIEEPRK

SEQ ID NO: 3026 - protein, 11 aa, Artificial
  IGFBP-2 heparin binding domain-containing peptide sequence
KRRLGIEEPRK

SEQ ID NO: 3027 - protein, 11 aa, Artificial
  IGFBP-2 heparin binding domain-containing peptide sequence
RRRLGIEEPRK

SEQ ID NO: 3028 - protein, 11 aa, Artificial
  IGFBP-2 heparin binding domain-containing peptide sequence
HRRLGIEEPRK

SEQ ID NO: 3029 - protein, 11 aa, Artificial
  IGFBP-2 heparin binding domain-containing peptide sequence
KHHIGIEEPRK

SEQ ID NO: 3030 - protein, 11 aa, Artificial
  IGFBP-2 heparin binding domain-containing peptide sequence
RHHIGIEEPRK

SEQ ID NO: 3031 - protein, 11 aa, Artificial
  IGFBP-2 heparin binding domain-containing peptide sequence
HHHIGIEEPRK

SEQ ID NO: 3032 - protein, 11 aa, Artificial
  IGFBP-2 heparin binding domain-containing peptide sequence
KKHIGIEEPRK

SEQ ID NO: 3033 - protein, 11 aa, Artificial
  IGFBP-2 heparin binding domain-containing peptide sequence
RKHIGIEEPRK

SEQ ID NO: 3034 - protein, 11 aa, Artificial
  IGFBP-2 heparin binding domain-containing peptide sequence
HKHIGIEEPRK

SEQ ID NO: 3035 - protein, 11 aa, Artificial
  IGFBP-2 heparin binding domain-containing peptide sequence
KRHIGIEEPRK

SEQ ID NO: 3036 - protein, 11 aa, Artificial
  IGFBP-2 heparin binding domain-containing peptide sequence
RRHIGIEEPRK

SEQ ID NO: 3037 - protein, 11 aa, Artificial
  IGFBP-2 heparin binding domain-containing peptide sequence
HRHIGIEEPRK

SEQ ID NO: 3038 - protein, 11 aa, Artificial
  IGFBP-2 heparin binding domain-containing peptide sequence
KHKIGIEEPRK

SEQ ID NO: 3039 - protein, 11 aa, Artificial
  IGFBP-2 heparin binding domain-containing peptide sequence
RHKIGIEEPRK

SEQ ID NO: 3040 - protein, 11 aa, Artificial
  IGFBP-2 heparin binding domain-containing peptide sequence
HHKIGIEEPRK

SEQ ID NO: 3041 - protein, 11 aa, Artificial
  IGFBP-2 heparin binding domain-containing peptide sequence
KKKIGIEEPRK

SEQ ID NO: 3042 - protein, 11 aa, Artificial
  IGFBP-2 heparin binding domain-containing peptide sequence
RKKIGIEEPRK

SEQ ID NO: 3043 - protein, 11 aa, Artificial
  IGFBP-2 heparin binding domain-containing peptide sequence
HKKIGIEEPRK

SEQ ID NO: 3044 - protein, 11 aa, Artificial
  IGFBP-2 heparin binding domain-containing peptide sequence
KRKIGIEEPRK

SEQ ID NO: 3045 - protein, 11 aa, Artificial
  IGFBP-2 heparin binding domain-containing peptide sequence
RRKIGIEEPRK

SEQ ID NO: 3046 - protein, 11 aa, Artificial
  IGFBP-2 heparin binding domain-containing peptide sequence
HRKIGIEEPRK

SEQ ID NO: 3047 - protein, 11 aa, Artificial
  IGFBP-2 heparin binding domain-containing peptide sequence
KHRIGIEEPRK

SEQ ID NO: 3048 - protein, 11 aa, Artificial
  IGFBP-2 heparin binding domain-containing peptide sequence
RHRIGIEEPRK

SEQ ID NO: 3049 - protein, 11 aa, Artificial
  IGFBP-2 heparin binding domain-containing peptide sequence
HHRIGIEEPRK

SEQ ID NO: 3050 - protein, 11 aa, Artificial
  IGFBP-2 heparin binding domain-containing peptide sequence
KKRIGIEEPRK

SEQ ID NO: 3051 - protein, 11 aa, Artificial
  IGFBP-2 heparin binding domain-containing peptide sequence
RKRIGIEEPRK

SEQ ID NO: 3052 - protein, 11 aa, Artificial
  IGFBP-2 heparin binding domain-containing peptide sequence
HKRIGIEEPRK

SEQ ID NO: 3053 - protein, 11 aa, Artificial
  IGFBP-2 heparin binding domain-containing peptide sequence
KRRIGIEEPRK

SEQ ID NO: 3054 - protein, 11 aa, Artificial
  IGFBP-2 heparin binding domain-containing peptide sequence
RRRIGIEEPRK

SEQ ID NO: 3055 - protein, 11 aa, Artificial
  IGFBP-2 heparin binding domain-containing peptide sequence
HRRIGIEEPRK

SEQ ID NO: 3056 - protein, 11 aa, Artificial
  IGFBP-2 heparin binding domain-containing peptide sequence
KHHVGIEEPRK

SEQ ID NO: 3057 - protein, 11 aa, Artificial
  IGFBP-2 heparin binding domain-containing peptide sequence
RHHVGIEEPRK

SEQ ID NO: 3058 - protein, 11 aa, Artificial
  IGFBP-2 heparin binding domain-containing peptide sequence
HHHVGIEEPRK

SEQ ID NO: 3059 - protein, 11 aa, Artificial
  IGFBP-2 heparin binding domain-containing peptide sequence
KKHVGIEEPRK

SEQ ID NO: 3060 - protein, 11 aa, Artificial
  IGFBP-2 heparin binding domain-containing peptide sequence
RKHVGIEEPRK

SEQ ID NO: 3061 - protein, 11 aa, Artificial
  IGFBP-2 heparin binding domain-containing peptide sequence
HKHVGIEEPRK

SEQ ID NO: 3062 - protein, 11 aa, Artificial
  IGFBP-2 heparin binding domain-containing peptide sequence
KRHVGIEEPRK

SEQ ID NO: 3063 - protein, 11 aa, Artificial
  IGFBP-2 heparin binding domain-containing peptide sequence
RRHVGIEEPRK

SEQ ID NO: 3064 - protein, 11 aa, Artificial
  IGFBP-2 heparin binding domain-containing peptide sequence
HRHVGIEEPRK

SEQ ID NO: 3065 - protein, 11 aa, Artificial
  IGFBP-2 heparin binding domain-containing peptide sequence
KHKVGIEEPRK

SEQ ID NO: 3066 - protein, 11 aa, Artificial
  IGFBP-2 heparin binding domain-containing peptide sequence
RHKVGIEEPRK

SEQ ID NO: 3067 - protein, 11 aa, Artificial
  IGFBP-2 heparin binding domain-containing peptide sequence
HHKVGIEEPRK

SEQ ID NO: 3068 - protein, 11 aa, Artificial
  IGFBP-2 heparin binding domain-containing peptide sequence
KKKVGIEEPRK

SEQ ID NO: 3069 - protein, 11 aa, Artificial
  IGFBP-2 heparin binding domain-containing peptide sequence
RKKVGIEEPRK

SEQ ID NO: 3070 - protein, 11 aa, Artificial
  IGFBP-2 heparin binding domain-containing peptide sequence
HKKVGIEEPRK

SEQ ID NO: 3071 - protein, 11 aa, Artificial
  IGFBP-2 heparin binding domain-containing peptide sequence
KRKVGIEEPRK

SEQ ID NO: 3072 - protein, 11 aa, Artificial
  IGFBP-2 heparin binding domain-containing peptide sequence
RRKVGIEEPRK

SEQ ID NO: 3073 - protein, 11 aa, Artificial
  IGFBP-2 heparin binding domain-containing peptide sequence
HRKVGIEEPRK

SEQ ID NO: 3074 - protein, 11 aa, Artificial
  IGFBP-2 heparin binding domain-containing peptide sequence
KHRVGIEEPRK

SEQ ID NO: 3075 - protein, 11 aa, Artificial
  IGFBP-2 heparin binding domain-containing peptide sequence
RHRVGIEEPRK

SEQ ID NO: 3076 - protein, 11 aa, Artificial
  IGFBP-2 heparin binding domain-containing peptide sequence
HHRVGIEEPRK

SEQ ID NO: 3077 - protein, 11 aa, Artificial
  IGFBP-2 heparin binding domain-containing peptide sequence
KKRVGIEEPRK

SEQ ID NO: 3078 - protein, 11 aa, Artificial
  IGFBP-2 heparin binding domain-containing peptide sequence
RKRVGIEEPRK

SEQ ID NO: 3079 - protein, 11 aa, Artificial
  IGFBP-2 heparin binding domain-containing peptide sequence
HKRVGIEEPRK

SEQ ID NO: 3080 - protein, 11 aa, Artificial
  IGFBP-2 heparin binding domain-containing peptide sequence
KRRVGIEEPRK

SEQ ID NO: 3081 - protein, 11 aa, Artificial
  IGFBP-2 heparin binding domain-containing peptide sequence
RRRVGIEEPRK

SEQ ID NO: 3082 - protein, 11 aa, Artificial
  IGFBP-2 heparin binding domain-containing peptide sequence
HRRVGIEEPRK

SEQ ID NO: 3083 - protein, 11 aa, Artificial
  IGFBP-2 heparin binding domain-containing peptide sequence
KHHLGVEEPRK

SEQ ID NO: 3084 - protein, 11 aa, Artificial
  IGFBP-2 heparin binding domain-containing peptide sequence
RHHLGVEEPRK

SEQ ID NO: 3085 - protein, 11 aa, Artificial
  IGFBP-2 heparin binding domain-containing peptide sequence
HHHLGVEEPRK

SEQ ID NO: 3086 - protein, 11 aa, Artificial
  IGFBP-2 heparin binding domain-containing peptide sequence
KKHLGVEEPRK

SEQ ID NO: 3087 - protein, 11 aa, Artificial
  IGFBP-2 heparin binding domain-containing peptide sequence
RKHLGVEEPRK

SEQ ID NO: 3088 - protein, 11 aa, Artificial
  IGFBP-2 heparin binding domain-containing peptide sequence
HKHLGVEEPRK

SEQ ID NO: 3089 - protein, 11 aa, Artificial
  IGFBP-2 heparin binding domain-containing peptide sequence
KRHLGVEEPRK

SEQ ID NO: 3090 - protein, 11 aa, Artificial
  IGFBP-2 heparin binding domain-containing peptide sequence
RRHLGVEEPRK

SEQ ID NO: 3091 - protein, 11 aa, Artificial
  IGFBP-2 heparin binding domain-containing peptide sequence
HRHLGVEEPRK

SEQ ID NO: 3092 - protein, 11 aa, Artificial
  IGFBP-2 heparin binding domain-containing peptide sequence
KHKLGVEEPRK

SEQ ID NO: 3093 - protein, 11 aa, Artificial
  IGFBP-2 heparin binding domain-containing peptide sequence
RHKLGVEEPRK

SEQ ID NO: 3094 - protein, 11 aa, Artificial
  IGFBP-2 heparin binding domain-containing peptide sequence
HHKLGVEEPRK

SEQ ID NO: 3095 - protein, 11 aa, Artificial
  IGFBP-2 heparin binding domain-containing peptide sequence
KKKLGVEEPRK

SEQ ID NO: 3096 - protein, 11 aa, Artificial
  IGFBP-2 heparin binding domain-containing peptide sequence
RKKLGVEEPRK

SEQ ID NO: 3097 - protein, 11 aa, Artificial
  IGFBP-2 heparin binding domain-containing peptide sequence
HKKLGVEEPRK

SEQ ID NO: 3098 - protein, 11 aa, Artificial
  IGFBP-2 heparin binding domain-containing peptide sequence
KRKLGVEEPRK

SEQ ID NO: 3099 - protein, 11 aa, Artificial
  IGFBP-2 heparin binding domain-containing peptide sequence
RRKLGVEEPRK

SEQ ID NO: 3100 - protein, 11 aa, Artificial
  IGFBP-2 heparin binding domain-containing peptide sequence
HRKLGVEEPRK

SEQ ID NO: 3101 - protein, 11 aa, Artificial
  IGFBP-2 heparin binding domain-containing peptide sequence
KHRLGVEEPRK

SEQ ID NO: 3102 - protein, 11 aa, Artificial
  IGFBP-2 heparin binding domain-containing peptide sequence
RHRLGVEEPRK

SEQ ID NO: 3103 - protein, 11 aa, Artificial
  IGFBP-2 heparin binding domain-containing peptide sequence
HHRLGVEEPRK

SEQ ID NO: 3104 - protein, 11 aa, Artificial
  IGFBP-2 heparin binding domain-containing peptide sequence
KKRLGVEEPRK

SEQ ID NO: 3105 - protein, 11 aa, Artificial
  IGFBP-2 heparin binding domain-containing peptide sequence
RKRLGVEEPRK

SEQ ID NO: 3106 - protein, 11 aa, Artificial
  IGFBP-2 heparin binding domain-containing peptide sequence
HKRLGVEEPRK

SEQ ID NO: 3107 - protein, 11 aa, Artificial
  IGFBP-2 heparin binding domain-containing peptide sequence
KRRLGVEEPRK

SEQ ID NO: 3108 - protein, 11 aa, Artificial
  IGFBP-2 heparin binding domain-containing peptide sequence
RRRLGVEEPRK

SEQ ID NO: 3109 - protein, 11 aa, Artificial
  IGFBP-2 heparin binding domain-containing peptide sequence
HRRLGVEEPRK

SEQ ID NO: 3110 - protein, 11 aa, Artificial
  IGFBP-2 heparin binding domain-containing peptide sequence
KHHIGVEEPRK

SEQ ID NO: 3111 - protein, 11 aa, Artificial
  IGFBP-2 heparin binding domain-containing peptide sequence
RHHIGVEEPRK

SEQ ID NO: 3112 - protein, 11 aa, Artificial
  IGFBP-2 heparin binding domain-containing peptide sequence
HHHIGVEEPRK

SEQ ID NO: 3113 - protein, 11 aa, Artificial
  IGFBP-2 heparin binding domain-containing peptide sequence
KKHIGVEEPRK

SEQ ID NO: 3114 - protein, 11 aa, Artificial
  IGFBP-2 heparin binding domain-containing peptide sequence
RKHIGVEEPRK

SEQ ID NO: 3115 - protein, 11 aa, Artificial
  IGFBP-2 heparin binding domain-containing peptide sequence
HKHIGVEEPRK

SEQ ID NO: 3116 - protein, 11 aa, Artificial
  IGFBP-2 heparin binding domain-containing peptide sequence
KRHIGVEEPRK

SEQ ID NO: 3117 - protein, 11 aa, Artificial
  IGFBP-2 heparin binding domain-containing peptide sequence
RRHIGVEEPRK

SEQ ID NO: 3118 - protein, 11 aa, Artificial
  IGFBP-2 heparin binding domain-containing peptide sequence
HRHIGVEEPRK

SEQ ID NO: 3119 - protein, 11 aa, Artificial
  IGFBP-2 heparin binding domain-containing peptide sequence
KHKIGVEEPRK

SEQ ID NO: 3120 - protein, 11 aa, Artificial
  IGFBP-2 heparin binding domain-containing peptide sequence
RHKIGVEEPRK

SEQ ID NO: 3121 - protein, 11 aa, Artificial
  IGFBP-2 heparin binding domain-containing peptide sequence
HHKIGVEEPRK

SEQ ID NO: 3122 - protein, 11 aa, Artificial
  IGFBP-2 heparin binding domain-containing peptide sequence
KKKIGVEEPRK

SEQ ID NO: 3123 - protein, 11 aa, Artificial
  IGFBP-2 heparin binding domain-containing peptide sequence
RKKIGVEEPRK

SEQ ID NO: 3124 - protein, 11 aa, Artificial
  IGFBP-2 heparin binding domain-containing peptide sequence
HKKIGVEEPRK

SEQ ID NO: 3125 - protein, 11 aa, Artificial
  IGFBP-2 heparin binding domain-containing peptide sequence
KRKIGVEEPRK

SEQ ID NO: 3126 - protein, 11 aa, Artificial
  IGFBP-2 heparin binding domain-containing peptide sequence
RRKIGVEEPRK

SEQ ID NO: 3127 - protein, 11 aa, Artificial
  IGFBP-2 heparin binding domain-containing peptide sequence
HRKIGVEEPRK

SEQ ID NO: 3128 - protein, 11 aa, Artificial
  IGFBP-2 heparin binding domain-containing peptide sequence
KHRIGVEEPRK

SEQ ID NO: 3129 - protein, 11 aa, Artificial
  IGFBP-2 heparin binding domain-containing peptide sequence
RHRIGVEEPRK

SEQ ID NO: 3130 - protein, 11 aa, Artificial
  IGFBP-2 heparin binding domain-containing peptide sequence
HHRIGVEEPRK

SEQ ID NO: 3131 - protein, 11 aa, Artificial
  IGFBP-2 heparin binding domain-containing peptide sequence
KKRIGVEEPRK

SEQ ID NO: 3132 - protein, 11 aa, Artificial
  IGFBP-2 heparin binding domain-containing peptide sequence
RKRIGVEEPRK

SEQ ID NO: 3133 - protein, 11 aa, Artificial
  IGFBP-2 heparin binding domain-containing peptide sequence
HKRIGVEEPRK

SEQ ID NO: 3134 - protein, 11 aa, Artificial
  IGFBP-2 heparin binding domain-containing peptide sequence
KRRIGVEEPRK

SEQ ID NO: 3135 - protein, 11 aa, Artificial
  IGFBP-2 heparin binding domain-containing peptide sequence
RRRIGVEEPRK

SEQ ID NO: 3136 - protein, 11 aa, Artificial
  IGFBP-2 heparin binding domain-containing peptide sequence
HRRIGVEEPRK

SEQ ID NO: 3137 - protein, 11 aa, Artificial
  IGFBP-2 heparin binding domain-containing peptide sequence
KHHVGVEEPRK

SEQ ID NO: 3138 - protein, 11 aa, Artificial
  IGFBP-2 heparin binding domain-containing peptide sequence
RHHVGVEEPRK

SEQ ID NO: 3139 - protein, 11 aa, Artificial
  IGFBP-2 heparin binding domain-containing peptide sequence
HHHVGVEEPRK

SEQ ID NO: 3140 - protein, 11 aa, Artificial
  IGFBP-2 heparin binding domain-containing peptide sequence
KKHVGVEEPRK

SEQ ID NO: 3141 - protein, 11 aa, Artificial
  IGFBP-2 heparin binding domain-containing peptide sequence
RKHVGVEEPRK

SEQ ID NO: 3142 - protein, 11 aa, Artificial
  IGFBP-2 heparin binding domain-containing peptide sequence
HKHVGVEEPRK

SEQ ID NO: 3143 - protein, 11 aa, Artificial
  IGFBP-2 heparin binding domain-containing peptide sequence
KRHVGVEEPRK

SEQ ID NO: 3144 - protein, 11 aa, Artificial
  IGFBP-2 heparin binding domain-containing peptide sequence
RRHVGVEEPRK

SEQ ID NO: 3145 - protein, 11 aa, Artificial
  IGFBP-2 heparin binding domain-containing peptide sequence
HRHVGVEEPRK

SEQ ID NO: 3146 - protein, 11 aa, Artificial
  IGFBP-2 heparin binding domain-containing peptide sequence
KHKVGVEEPRK

SEQ ID NO: 3147 - protein, 11 aa, Artificial
  IGFBP-2 heparin binding domain-containing peptide sequence
RHKVGVEEPRK

SEQ ID NO: 3148 - protein, 11 aa, Artificial
  IGFBP-2 heparin binding domain-containing peptide sequence
HHKVGVEEPRK

SEQ ID NO: 3149 - protein, 11 aa, Artificial
  IGFBP-2 heparin binding domain-containing peptide sequence
KKKVGVEEPRK

SEQ ID NO: 3150 - protein, 11 aa, Artificial
  IGFBP-2 heparin binding domain-containing peptide sequence
RKKVGVEEPRK

SEQ ID NO: 3151 - protein, 11 aa, Artificial
  IGFBP-2 heparin binding domain-containing peptide sequence
HKKVGVEEPRK

SEQ ID NO: 3152 - protein, 11 aa, Artificial
  IGFBP-2 heparin binding domain-containing peptide sequence
KRKVGVEEPRK

SEQ ID NO: 3153 - protein, 11 aa, Artificial
  IGFBP-2 heparin binding domain-containing peptide sequence
RRKVGVEEPRK

SEQ ID NO: 3154 - protein, 11 aa, Artificial
  IGFBP-2 heparin binding domain-containing peptide sequence
HRKVGVEEPRK

SEQ ID NO: 3155 - protein, 11 aa, Artificial
  IGFBP-2 heparin binding domain-containing peptide sequence
KHRVGVEEPRK

SEQ ID NO: 3156 - protein, 11 aa, Artificial
  IGFBP-2 heparin binding domain-containing peptide sequence
RHRVGVEEPRK

SEQ ID NO: 3157 - protein, 11 aa, Artificial
  IGFBP-2 heparin binding domain-containing peptide sequence
HHRVGVEEPRK

SEQ ID NO: 3158 - protein, 11 aa, Artificial
  IGFBP-2 heparin binding domain-containing peptide sequence
KKRVGVEEPRK

SEQ ID NO: 3159 - protein, 11 aa, Artificial
  IGFBP-2 heparin binding domain-containing peptide sequence
RKRVGVEEPRK

SEQ ID NO: 3160 - protein, 11 aa, Artificial
  IGFBP-2 heparin binding domain-containing peptide sequence
HKRVGVEEPRK

SEQ ID NO: 3161 - protein, 11 aa, Artificial
  IGFBP-2 heparin binding domain-containing peptide sequence
KRRVGVEEPRK

SEQ ID NO: 3162 - protein, 11 aa, Artificial
  IGFBP-2 heparin binding domain-containing peptide sequence
RRRVGVEEPRK

SEQ ID NO: 3163 - protein, 11 aa, Artificial
  IGFBP-2 heparin binding domain-containing peptide sequence
HRRVGVEEPRK

SEQ ID NO: 3164 - protein, 11 aa, Artificial
  IGFBP-2 heparin binding domain-containing peptide sequence
KHHLGLNEPRK

SEQ ID NO: 3165 - protein, 11 aa, Artificial
  IGFBP-2 heparin binding domain-containing peptide sequence
RHHLGLNEPRK

SEQ ID NO: 3166 - protein, 11 aa, Artificial
  IGFBP-2 heparin binding domain-containing peptide sequence
HHHLGLNEPRK

SEQ ID NO: 3167 - protein, 11 aa, Artificial
  IGFBP-2 heparin binding domain-containing peptide sequence
KKHLGLNEPRK

SEQ ID NO: 3168 - protein, 11 aa, Artificial
  IGFBP-2 heparin binding domain-containing peptide sequence
RKHLGLNEPRK

SEQ ID NO: 3169 - protein, 11 aa, Artificial
  IGFBP-2 heparin binding domain-containing peptide sequence
HKHLGLNEPRK

SEQ ID NO: 3170 - protein, 11 aa, Artificial
  IGFBP-2 heparin binding domain-containing peptide sequence
KRHLGLNEPRK

SEQ ID NO: 3171 - protein, 11 aa, Artificial
  IGFBP-2 heparin binding domain-containing peptide sequence
RRHLGLNEPRK

SEQ ID NO: 3172 - protein, 11 aa, Artificial
  IGFBP-2 heparin binding domain-containing peptide sequence
HRHLGLNEPRK

SEQ ID NO: 3173 - protein, 11 aa, Artificial
  IGFBP-2 heparin binding domain-containing peptide sequence
KHKLGLNEPRK

SEQ ID NO: 3174 - protein, 11 aa, Artificial
  IGFBP-2 heparin binding domain-containing peptide sequence
RHKLGLNEPRK

SEQ ID NO: 3175 - protein, 11 aa, Artificial
  IGFBP-2 heparin binding domain-containing peptide sequence
HHKLGLNEPRK

SEQ ID NO: 3176 - protein, 11 aa, Artificial
  IGFBP-2 heparin binding domain-containing peptide sequence
KKKLGLNEPRK

SEQ ID NO: 3177 - protein, 11 aa, Artificial
  IGFBP-2 heparin binding domain-containing peptide sequence
RKKLGLNEPRK

SEQ ID NO: 3178 - protein, 11 aa, Artificial
  IGFBP-2 heparin binding domain-containing peptide sequence
HKKLGLNEPRK

SEQ ID NO: 3179 - protein, 11 aa, Artificial
  IGFBP-2 heparin binding domain-containing peptide sequence
KRKLGLNEPRK

SEQ ID NO: 3180 - protein, 11 aa, Artificial
  IGFBP-2 heparin binding domain-containing peptide sequence
RRKLGLNEPRK

SEQ ID NO: 3181 - protein, 11 aa, Artificial
  IGFBP-2 heparin binding domain-containing peptide sequence
HRKLGLNEPRK

SEQ ID NO: 3182 - protein, 11 aa, Artificial
  IGFBP-2 heparin binding domain-containing peptide sequence
KHRLGLNEPRK

SEQ ID NO: 3183 - protein, 11 aa, Artificial
  IGFBP-2 heparin binding domain-containing peptide sequence
RHRLGLNEPRK

SEQ ID NO: 3184 - protein, 11 aa, Artificial
  IGFBP-2 heparin binding domain-containing peptide sequence
HHRLGLNEPRK

SEQ ID NO: 3185 - protein, 11 aa, Artificial
  IGFBP-2 heparin binding domain-containing peptide sequence
KKRLGLNEPRK

SEQ ID NO: 3186 - protein, 11 aa, Artificial
  IGFBP-2 heparin binding domain-containing peptide sequence
RKRLGLNEPRK

SEQ ID NO: 3187 - protein, 11 aa, Artificial
  IGFBP-2 heparin binding domain-containing peptide sequence
HKRLGLNEPRK

SEQ ID NO: 3188 - protein, 11 aa, Artificial
  IGFBP-2 heparin binding domain-containing peptide sequence
KRRLGLNEPRK

SEQ ID NO: 3189 - protein, 11 aa, Artificial
  IGFBP-2 heparin binding domain-containing peptide sequence
RRRLGLNEPRK

SEQ ID NO: 3190 - protein, 11 aa, Artificial
  IGFBP-2 heparin binding domain-containing peptide sequence
HRRLGLNEPRK

SEQ ID NO: 3191 - protein, 10 aa, Artificial
  IGFBP-2 heparin binding domain-containing peptide sequence
KHHIGLNPRK

SEQ ID NO: 3192 - protein, 11 aa, Artificial
  IGFBP-2 heparin binding domain-containing peptide sequence
RHHIGLNEPRK

SEQ ID NO: 3193 - protein, 11 aa, Artificial
  IGFBP-2 heparin binding domain-containing peptide sequence
HHHIGLNEPRK

SEQ ID NO: 3194 - protein, 11 aa, Artificial
  IGFBP-2 heparin binding domain-containing peptide sequence
KKHIGLNEPRK

SEQ ID NO: 3195 - protein, 11 aa, Artificial
  IGFBP-2 heparin binding domain-containing peptide sequence
RKHIGLNEPRK

SEQ ID NO: 3196 - protein, 11 aa, Artificial
  IGFBP-2 heparin binding domain-containing peptide sequence
HKHIGLNEPRK

SEQ ID NO: 3197 - protein, 11 aa, Artificial
  IGFBP-2 heparin binding domain-containing peptide sequence
KRHIGLNEPRK

SEQ ID NO: 3198 - protein, 11 aa, Artificial
  IGFBP-2 heparin binding domain-containing peptide sequence
RRHIGLNEPRK

SEQ ID NO: 3199 - protein, 11 aa, Artificial
  IGFBP-2 heparin binding domain-containing peptide sequence
HRHIGLNEPRK

SEQ ID NO: 3200 - protein, 11 aa, Artificial
  IGFBP-2 heparin binding domain-containing peptide sequence
KHKIGLNEPRK

SEQ ID NO: 3201 - protein, 11 aa, Artificial
  IGFBP-2 heparin binding domain-containing peptide sequence
RHKIGLNEPRK

SEQ ID NO: 3202 - protein, 11 aa, Artificial
  IGFBP-2 heparin binding domain-containing peptide sequence
HHKIGLNEPRK

SEQ ID NO: 3203 - protein, 11 aa, Artificial
  IGFBP-2 heparin binding domain-containing peptide sequence
KKKIGLNEPRK

SEQ ID NO: 3204 - protein, 11 aa, Artificial
  IGFBP-2 heparin binding domain-containing peptide sequence
RKKIGLNEPRK

SEQ ID NO: 3205 - protein, 11 aa, Artificial
  IGFBP-2 heparin binding domain-containing peptide sequence
HKKIGLNEPRK

SEQ ID NO: 3206 - protein, 11 aa, Artificial
  IGFBP-2 heparin binding domain-containing peptide sequence
KRKIGLNEPRK

SEQ ID NO: 3207 - protein, 11 aa, Artificial
  IGFBP-2 heparin binding domain-containing peptide sequence
RRKIGLNEPRK

SEQ ID NO: 3208 - protein, 11 aa, Artificial
  IGFBP-2 heparin binding domain-containing peptide sequence
HRKIGLNEPRK

SEQ ID NO: 3209 - protein, 11 aa, Artificial
  IGFBP-2 heparin binding domain-containing peptide sequence
KHRIGLNEPRK

SEQ ID NO: 3210 - protein, 11 aa, Artificial
  IGFBP-2 heparin binding domain-containing peptide sequence
RHRIGLNEPRK

SEQ ID NO: 3211 - protein, 11 aa, Artificial
  IGFBP-2 heparin binding domain-containing peptide sequence
HHRIGLNEPRK

SEQ ID NO: 3212 - protein, 11 aa, Artificial
  IGFBP-2 heparin binding domain-containing peptide sequence
KKRIGLNEPRK

SEQ ID NO: 3213 - protein, 11 aa, Artificial
  IGFBP-2 heparin binding domain-containing peptide sequence
RKRIGLNEPRK

SEQ ID NO: 3214 - protein, 11 aa, Artificial
  IGFBP-2 heparin binding domain-containing peptide sequence
HKRIGLNEPRK

SEQ ID NO: 3215 - protein, 11 aa, Artificial
  IGFBP-2 heparin binding domain-containing peptide sequence
KRRIGLNEPRK

SEQ ID NO: 3216 - protein, 11 aa, Artificial
  IGFBP-2 heparin binding domain-containing peptide sequence
RRRIGLNEPRK

SEQ ID NO: 3217 - protein, 11 aa, Artificial
  IGFBP-2 heparin binding domain-containing peptide sequence
HRRIGLNEPRK

SEQ ID NO: 3218 - protein, 11 aa, Artificial
  IGFBP-2 heparin binding domain-containing peptide sequence
KHHVGLNEPRK

SEQ ID NO: 3219 - protein, 11 aa, Artificial
  IGFBP-2 heparin binding domain-containing peptide sequence
RHHVGLNEPRK

SEQ ID NO: 3220 - protein, 11 aa, Artificial
  IGFBP-2 heparin binding domain-containing peptide sequence
HHHVGLNEPRK

SEQ ID NO: 3221 - protein, 11 aa, Artificial
  IGFBP-2 heparin binding domain-containing peptide sequence
KKHVGLNEPRK

SEQ ID NO: 3222 - protein, 11 aa, Artificial
  IGFBP-2 heparin binding domain-containing peptide sequence
RKHVGLNEPRK

SEQ ID NO: 3223 - protein, 11 aa, Artificial
  IGFBP-2 heparin binding domain-containing peptide sequence
HKHVGLNEPRK

SEQ ID NO: 3224 - protein, 11 aa, Artificial
  IGFBP-2 heparin binding domain-containing peptide sequence
KRHVGLNEPRK

SEQ ID NO: 3225 - protein, 11 aa, Artificial
  IGFBP-2 heparin binding domain-containing peptide sequence
RRHVGLNEPRK

SEQ ID NO: 3226 - protein, 11 aa, Artificial
  IGFBP-2 heparin binding domain-containing peptide sequence
HRHVGLNEPRK

SEQ ID NO: 3227 - protein, 11 aa, Artificial
  IGFBP-2 heparin binding domain-containing peptide sequence
KHKVGLNEPRK

SEQ ID NO: 3228 - protein, 11 aa, Artificial
  IGFBP-2 heparin binding domain-containing peptide sequence
RHKVGLNEPRK

SEQ ID NO: 3229 - protein, 11 aa, Artificial
  IGFBP-2 heparin binding domain-containing peptide sequence
HHKVGLNEPRK

SEQ ID NO: 3230 - protein, 11 aa, Artificial
  IGFBP-2 heparin binding domain-containing peptide sequence
KKKVGLNEPRK

SEQ ID NO: 3231 - protein, 11 aa, Artificial
  IGFBP-2 heparin binding domain-containing peptide sequence
RKKVGLNEPRK

SEQ ID NO: 3232 - protein, 11 aa, Artificial
  IGFBP-2 heparin binding domain-containing peptide sequence
HKKVGLNEPRK

SEQ ID NO: 3233 - protein, 11 aa, Artificial
  IGFBP-2 heparin binding domain-containing peptide sequence
KRKVGLNEPRK

SEQ ID NO: 3234 - protein, 11 aa, Artificial
  IGFBP-2 heparin binding domain-containing peptide sequence
RRKVGLNEPRK

SEQ ID NO: 3235 - protein, 11 aa, Artificial
  IGFBP-2 heparin binding domain-containing peptide sequence
HRKVGLNEPRK

SEQ ID NO: 3236 - protein, 11 aa, Artificial
  IGFBP-2 heparin binding domain-containing peptide sequence
KHRVGLNEPRK

SEQ ID NO: 3237 - protein, 11 aa, Artificial
  IGFBP-2 heparin binding domain-containing peptide sequence
RHRVGLNEPRK

SEQ ID NO: 3238 - protein, 11 aa, Artificial
  IGFBP-2 heparin binding domain-containing peptide sequence
HHRVGLNEPRK

SEQ ID NO: 3239 - protein, 11 aa, Artificial
  IGFBP-2 heparin binding domain-containing peptide sequence
KKRVGLNEPRK

SEQ ID NO: 3240 - protein, 11 aa, Artificial
  IGFBP-2 heparin binding domain-containing peptide sequence
RKRVGLNEPRK

SEQ ID NO: 3241 - protein, 11 aa, Artificial
  IGFBP-2 heparin binding domain-containing peptide sequence
HKRVGLNEPRK

SEQ ID NO: 3242 - protein, 11 aa, Artificial
  IGFBP-2 heparin binding domain-containing peptide sequence
KRRVGLNEPRK

SEQ ID NO: 3243 - protein, 11 aa, Artificial
  IGFBP-2 heparin binding domain-containing peptide sequence
RRRVGLNEPRK

SEQ ID NO: 3244 - protein, 11 aa, Artificial
  IGFBP-2 heparin binding domain-containing peptide sequence
HRRVGLNEPRK

SEQ ID NO: 3245 - protein, 11 aa, Artificial
  IGFBP-2 heparin binding domain-containing peptide sequence
KHHLGINEPRK

SEQ ID NO: 3246 - protein, 11 aa, Artificial
  IGFBP-2 heparin binding domain-containing peptide sequence
RHHLGINEPRK

SEQ ID NO: 3247 - protein, 11 aa, Artificial
  IGFBP-2 heparin binding domain-containing peptide sequence
HHHLGINEPRK

SEQ ID NO: 3248 - protein, 11 aa, Artificial
  IGFBP-2 heparin binding domain-containing peptide sequence
KKHLGINEPRK

SEQ ID NO: 3249 - protein, 11 aa, Artificial
  IGFBP-2 heparin binding domain-containing peptide sequence
RKHLGINEPRK

SEQ ID NO: 3250 - protein, 11 aa, Artificial
  IGFBP-2 heparin binding domain-containing peptide sequence
HKHLGINEPRK

SEQ ID NO: 3251 - protein, 11 aa, Artificial
  IGFBP-2 heparin binding domain-containing peptide sequence
KRHLGINEPRK

SEQ ID NO: 3252 - protein, 11 aa, Artificial
  IGFBP-2 heparin binding domain-containing peptide sequence
RRHLGINEPRK

SEQ ID NO: 3253 - protein, 11 aa, Artificial
  IGFBP-2 heparin binding domain-containing peptide sequence
HRHLGINEPRK

SEQ ID NO: 3254 - protein, 11 aa, Artificial
  IGFBP-2 heparin binding domain-containing peptide sequence
KHKLGINEPRK

SEQ ID NO: 3255 - protein, 11 aa, Artificial
  IGFBP-2 heparin binding domain-containing peptide sequence
RHKLGINEPRK

SEQ ID NO: 3256 - protein, 11 aa, Artificial
  IGFBP-2 heparin binding domain-containing peptide sequence
HHKLGINEPRK

SEQ ID NO: 3257 - protein, 11 aa, Artificial
  IGFBP-2 heparin binding domain-containing peptide sequence
KKKLGINEPRK

SEQ ID NO: 3258 - protein, 11 aa, Artificial
  IGFBP-2 heparin binding domain-containing peptide sequence
RKKLGINEPRK

SEQ ID NO: 3259 - protein, 11 aa, Artificial
  IGFBP-2 heparin binding domain-containing peptide sequence
HKKLGINEPRK

SEQ ID NO: 3260 - protein, 11 aa, Artificial
  IGFBP-2 heparin binding domain-containing peptide sequence
KRKLGINEPRK

SEQ ID NO: 3261 - protein, 11 aa, Artificial
  IGFBP-2 heparin binding domain-containing peptide sequence
RRKLGINEPRK

SEQ ID NO: 3262 - protein, 11 aa, Artificial
  IGFBP-2 heparin binding domain-containing peptide sequence
HRKLGINEPRK

SEQ ID NO: 3263 - protein, 11 aa, Artificial
  IGFBP-2 heparin binding domain-containing peptide sequence
KHRLGINEPRK

SEQ ID NO: 3264 - protein, 11 aa, Artificial
  IGFBP-2 heparin binding domain-containing peptide sequence
RHRLGINEPRK

SEQ ID NO: 3265 - protein, 11 aa, Artificial
  IGFBP-2 heparin binding domain-containing peptide sequence
HHRLGINEPRK

SEQ ID NO: 3266 - protein, 11 aa, Artificial
  IGFBP-2 heparin binding domain-containing peptide sequence
KKRLGINEPRK

SEQ ID NO: 3267 - protein, 11 aa, Artificial
  IGFBP-2 heparin binding domain-containing peptide sequence
RKRLGINEPRK

SEQ ID NO: 3268 - protein, 11 aa, Artificial
  IGFBP-2 heparin binding domain-containing peptide sequence
HKRLGINEPRK

SEQ ID NO: 3269 - protein, 11 aa, Artificial
  IGFBP-2 heparin binding domain-containing peptide sequence
KRRLGINEPRK

SEQ ID NO: 3270 - protein, 11 aa, Artificial
  IGFBP-2 heparin binding domain-containing peptide sequence
RRRLGINEPRK

SEQ ID NO: 3271 - protein, 11 aa, Artificial
  IGFBP-2 heparin binding domain-containing peptide sequence
HRRLGINEPRK

SEQ ID NO: 3272 - protein, 11 aa, Artificial
  IGFBP-2 heparin binding domain-containing peptide sequence
KHHIGIENPRK

SEQ ID NO: 3273 - protein, 11 aa, Artificial
  IGFBP-2 heparin binding domain-containing peptide sequence
RHHIGINEPRK

SEQ ID NO: 3274 - protein, 11 aa, Artificial
  IGFBP-2 heparin binding domain-containing peptide sequence
HHHIGINEPRK

SEQ ID NO: 3275 - protein, 11 aa, Artificial
  IGFBP-2 heparin binding domain-containing peptide sequence
KKHIGINEPRK

SEQ ID NO: 3276 - protein, 11 aa, Artificial
  IGFBP-2 heparin binding domain-containing peptide sequence
RKHIGINEPRK

SEQ ID NO: 3277 - protein, 11 aa, Artificial
  IGFBP-2 heparin binding domain-containing peptide sequence
HKHIGINEPRK

SEQ ID NO: 3278 - protein, 11 aa, Artificial
  IGFBP-2 heparin binding domain-containing peptide sequence
KRHIGINEPRK

SEQ ID NO: 3279 - protein, 11 aa, Artificial
  IGFBP-2 heparin binding domain-containing peptide sequence
RRHIGINEPRK

SEQ ID NO: 3280 - protein, 11 aa, Artificial
  IGFBP-2 heparin binding domain-containing peptide sequence
HRHIGINEPRK

SEQ ID NO: 3281 - protein, 11 aa, Artificial
  IGFBP-2 heparin binding domain-containing peptide sequence
KHKIGINEPRK

SEQ ID NO: 3282 - protein, 11 aa, Artificial
  IGFBP-2 heparin binding domain-containing peptide sequence
RHKIGINEPRK

SEQ ID NO: 3283 - protein, 11 aa, Artificial
  IGFBP-2 heparin binding domain-containing peptide sequence
HHKIGINEPRK

SEQ ID NO: 3284 - protein, 11 aa, Artificial
  IGFBP-2 heparin binding domain-containing peptide sequence
KKKIGINEPRK

SEQ ID NO: 3285 - protein, 11 aa, Artificial
  IGFBP-2 heparin binding domain-containing peptide sequence
RKKIGINEPRK

SEQ ID NO: 3286 - protein, 11 aa, Artificial
  IGFBP-2 heparin binding domain-containing peptide sequence
HKKIGINEPRK

SEQ ID NO: 3287 - protein, 11 aa, Artificial
  IGFBP-2 heparin binding domain-containing peptide sequence
KRKIGINEPRK

SEQ ID NO: 3288 - protein, 11 aa, Artificial
  IGFBP-2 heparin binding domain-containing peptide sequence
RRKIGINEPRK

SEQ ID NO: 3289 - protein, 11 aa, Artificial
  IGFBP-2 heparin binding domain-containing peptide sequence
HRKIGINEPRK

SEQ ID NO: 3290 - protein, 11 aa, Artificial
  IGFBP-2 heparin binding domain-containing peptide sequence
KHRIGINEPRK

SEQ ID NO: 3291 - protein, 11 aa, Artificial
  IGFBP-2 heparin binding domain-containing peptide sequence
RHRIGINEPRK

SEQ ID NO: 3292 - protein, 11 aa, Artificial
  IGFBP-2 heparin binding domain-containing peptide sequence
HHRIGINEPRK

SEQ ID NO: 3293 - protein, 11 aa, Artificial
  IGFBP-2 heparin binding domain-containing peptide sequence
KKRIGINEPRK

SEQ ID NO: 3294 - protein, 11 aa, Artificial
  IGFBP-2 heparin binding domain-containing peptide sequence
RKRIGINEPRK

SEQ ID NO: 3295 - protein, 11 aa, Artificial
  IGFBP-2 heparin binding domain-containing peptide sequence
HKRIGINEPRK

SEQ ID NO: 3296 - protein, 11 aa, Artificial
  IGFBP-2 heparin binding domain-containing peptide sequence
KRRIGINEPRK

SEQ ID NO: 3297 - protein, 11 aa, Artificial
  IGFBP-2 heparin binding domain-containing peptide sequence
RRRIGINEPRK

SEQ ID NO: 3298 - protein, 11 aa, Artificial
  IGFBP-2 heparin binding domain-containing peptide sequence
HRRIGINEPRK

SEQ ID NO: 3299 - protein, 11 aa, Artificial
  IGFBP-2 heparin binding domain-containing peptide sequence
KHHVGINEPRK

SEQ ID NO: 3300 - protein, 11 aa, Artificial
  IGFBP-2 heparin binding domain-containing peptide sequence
RHHVGINEPRK

SEQ ID NO: 3301 - protein, 11 aa, Artificial
  IGFBP-2 heparin binding domain-containing peptide sequence
HHHVGINEPRK

SEQ ID NO: 3302 - protein, 11 aa, Artificial
  IGFBP-2 heparin binding domain-containing peptide sequence
KKHVGINEPRK

SEQ ID NO: 3303 - protein, 11 aa, Artificial
  IGFBP-2 heparin binding domain-containing peptide sequence
RKHVGINEPRK

SEQ ID NO: 3304 - protein, 11 aa, Artificial
  IGFBP-2 heparin binding domain-containing peptide sequence
HKHVGINEPRK

SEQ ID NO: 3305 - protein, 11 aa, Artificial
  IGFBP-2 heparin binding domain-containing peptide sequence
KRHVGINEPRK

SEQ ID NO: 3306 - protein, 11 aa, Artificial
  IGFBP-2 heparin binding domain-containing peptide sequence
RRHVGINEPRK

SEQ ID NO: 3307 - protein, 11 aa, Artificial
  IGFBP-2 heparin binding domain-containing peptide sequence
HRHVGINEPRK

SEQ ID NO: 3308 - protein, 11 aa, Artificial
  IGFBP-2 heparin binding domain-containing peptide sequence
KHKVGINEPRK

SEQ ID NO: 3309 - protein, 11 aa, Artificial
  IGFBP-2 heparin binding domain-containing peptide sequence
RHKVGINEPRK

SEQ ID NO: 3310 - protein, 11 aa, Artificial
  IGFBP-2 heparin binding domain-containing peptide sequence
HHKVGINEPRK

SEQ ID NO: 3311 - protein, 11 aa, Artificial
  IGFBP-2 heparin binding domain-containing peptide sequence
KKKVGINEPRK

SEQ ID NO: 3312 - protein, 11 aa, Artificial
  IGFBP-2 heparin binding domain-containing peptide sequence
RKKVGINEPRK

SEQ ID NO: 3313 - protein, 11 aa, Artificial
  IGFBP-2 heparin binding domain-containing peptide sequence
HKKVGINEPRK

SEQ ID NO: 3314 - protein, 11 aa, Artificial
  IGFBP-2 heparin binding domain-containing peptide sequence
KRKVGINEPRK

SEQ ID NO: 3315 - protein, 11 aa, Artificial
  IGFBP-2 heparin binding domain-containing peptide sequence
RRKVGINEPRK

SEQ ID NO: 3316 - protein, 11 aa, Artificial
  IGFBP-2 heparin binding domain-containing peptide sequence
HRKVGINEPRK

SEQ ID NO: 3317 - protein, 11 aa, Artificial
  IGFBP-2 heparin binding domain-containing peptide sequence
KHRVGINEPRK

SEQ ID NO: 3318 - protein, 11 aa, Artificial
  IGFBP-2 heparin binding domain-containing peptide sequence
RHRVGINEPRK

SEQ ID NO: 3319 - protein, 11 aa, Artificial
  IGFBP-2 heparin binding domain-containing peptide sequence
HHRVGINEPRK

SEQ ID NO: 3320 - protein, 11 aa, Artificial
  IGFBP-2 heparin binding domain-containing peptide sequence
KKRVGINEPRK

SEQ ID NO: 3321 - protein, 11 aa, Artificial
  IGFBP-2 heparin binding domain-containing peptide sequence
RKRVGINEPRK

SEQ ID NO: 3322 - protein, 11 aa, Artificial
  IGFBP-2 heparin binding domain-containing peptide sequence
HKRVGINEPRK

SEQ ID NO: 3323 - protein, 11 aa, Artificial
  IGFBP-2 heparin binding domain-containing peptide sequence
KRRVGINEPRK

SEQ ID NO: 3324 - protein, 11 aa, Artificial
  IGFBP-2 heparin binding domain-containing peptide sequence
RRRVGINEPRK

SEQ ID NO: 3325 - protein, 11 aa, Artificial
  IGFBP-2 heparin binding domain-containing peptide sequence
HRRVGINEPRK

SEQ ID NO: 3326 - protein, 11 aa, Artificial
  IGFBP-2 heparin binding domain-containing peptide sequence
KHHLGVNEPRK

SEQ ID NO: 3327 - protein, 11 aa, Artificial
  IGFBP-2 heparin binding domain-containing peptide sequence
RHHLGVNEPRK

SEQ ID NO: 3328 - protein, 11 aa, Artificial
  IGFBP-2 heparin binding domain-containing peptide sequence
HHHLGVNEPRK

SEQ ID NO: 3329 - protein, 11 aa, Artificial
  IGFBP-2 heparin binding domain-containing peptide sequence
KKHLGVNEPRK

SEQ ID NO: 3330 - protein, 11 aa, Artificial
  IGFBP-2 heparin binding domain-containing peptide sequence
RKHLGVNEPRK

SEQ ID NO: 3331 - protein, 11 aa, Artificial
  IGFBP-2 heparin binding domain-containing peptide sequence
HKHLGVNEPRK

SEQ ID NO: 3332 - protein, 11 aa, Artificial
  IGFBP-2 heparin binding domain-containing peptide sequence
KRHLGVNEPRK

SEQ ID NO: 3333 - protein, 11 aa, Artificial
  IGFBP-2 heparin binding domain-containing peptide sequence
RRHLGVNEPRK

SEQ ID NO: 3334 - protein, 11 aa, Artificial
  IGFBP-2 heparin binding domain-containing peptide sequence
HRHLGVNEPRK

SEQ ID NO: 3335 - protein, 11 aa, Artificial
  IGFBP-2 heparin binding domain-containing peptide sequence
KHKLGVNEPRK

SEQ ID NO: 3336 - protein, 11 aa, Artificial
  IGFBP-2 heparin binding domain-containing peptide sequence
RHKLGVNEPRK

SEQ ID NO: 3337 - protein, 11 aa, Artificial
  IGFBP-2 heparin binding domain-containing peptide sequence
HHKLGVNEPRK

SEQ ID NO: 3338 - protein, 11 aa, Artificial
  IGFBP-2 heparin binding domain-containing peptide sequence
KKKLGVNEPRK

SEQ ID NO: 3339 - protein, 11 aa, Artificial
  IGFBP-2 heparin binding domain-containing peptide sequence
RKKLGVNEPRK

SEQ ID NO: 3340 - protein, 11 aa, Artificial
  IGFBP-2 heparin binding domain-containing peptide sequence
HKKLGVNEPRK

SEQ ID NO: 3341 - protein, 11 aa, Artificial
  IGFBP-2 heparin binding domain-containing peptide sequence
KRKLGVNEPRK

SEQ ID NO: 3342 - protein, 11 aa, Artificial
  IGFBP-2 heparin binding domain-containing peptide sequence
RRKLGVNEPRK

SEQ ID NO: 3343 - protein, 11 aa, Artificial
  IGFBP-2 heparin binding domain-containing peptide sequence
HRKLGVNEPRK

SEQ ID NO: 3344 - protein, 11 aa, Artificial
  IGFBP-2 heparin binding domain-containing peptide sequence
KHRLGVNEPRK

SEQ ID NO: 3345 - protein, 11 aa, Artificial
  IGFBP-2 heparin binding domain-containing peptide sequence
RHRLGVNEPRK

SEQ ID NO: 3346 - protein, 11 aa, Artificial
  IGFBP-2 heparin binding domain-containing peptide sequence
HHRLGVNEPRK

SEQ ID NO: 3347 - protein, 11 aa, Artificial
  IGFBP-2 heparin binding domain-containing peptide sequence
KKRLGVNEPRK

SEQ ID NO: 3348 - protein, 11 aa, Artificial
  IGFBP-2 heparin binding domain-containing peptide sequence
RKRLGVNEPRK

SEQ ID NO: 3349 - protein, 11 aa, Artificial
  IGFBP-2 heparin binding domain-containing peptide sequence
HKRLGVNEPRK

SEQ ID NO: 3350 - protein, 11 aa, Artificial
  IGFBP-2 heparin binding domain-containing peptide sequence
KRRLGVNEPRK

SEQ ID NO: 3351 - protein, 11 aa, Artificial
  IGFBP-2 heparin binding domain-containing peptide sequence
RRRLGVNEPRK

SEQ ID NO: 3352 - protein, 11 aa, Artificial
  IGFBP-2 heparin binding domain-containing peptide sequence
HRRLGVNEPRK

SEQ ID NO: 3353 - protein, 11 aa, Artificial
  IGFBP-2 heparin binding domain-containing peptide sequence
KHHIGVNEPRK

SEQ ID NO: 3354 - protein, 11 aa, Artificial
  IGFBP-2 heparin binding domain-containing peptide sequence
RHHIGVNEPRK

SEQ ID NO: 3355 - protein, 11 aa, Artificial
  IGFBP-2 heparin binding domain-containing peptide sequence
HHHIGVNEPRK

SEQ ID NO: 3356 - protein, 11 aa, Artificial
  IGFBP-2 heparin binding domain-containing peptide sequence
KKHIGVNEPRK

SEQ ID NO: 3357 - protein, 11 aa, Artificial
  IGFBP-2 heparin binding domain-containing peptide sequence
RKHIGVNEPRK

SEQ ID NO: 3358 - protein, 11 aa, Artificial
  IGFBP-2 heparin binding domain-containing peptide sequence
HKHIGVNEPRK

SEQ ID NO: 3359 - protein, 11 aa, Artificial
  IGFBP-2 heparin binding domain-containing peptide sequence
KRHIGVNEPRK

SEQ ID NO: 3360 - protein, 11 aa, Artificial
  IGFBP-2 heparin binding domain-containing peptide sequence
RRHIGVNEPRK

SEQ ID NO: 3361 - protein, 11 aa, Artificial
  IGFBP-2 heparin binding domain-containing peptide sequence
HRHIGVNEPRK

SEQ ID NO: 3362 - protein, 11 aa, Artificial
  IGFBP-2 heparin binding domain-containing peptide sequence
KHKIGVNEPRK

SEQ ID NO: 3363 - protein, 11 aa, Artificial
  IGFBP-2 heparin binding domain-containing peptide sequence
RHKIGVNEPRK

SEQ ID NO: 3364 - protein, 11 aa, Artificial
  IGFBP-2 heparin binding domain-containing peptide sequence
HHKIGVNEPRK

SEQ ID NO: 3365 - protein, 11 aa, Artificial
  IGFBP-2 heparin binding domain-containing peptide sequence
KKKIGVNEPRK

SEQ ID NO: 3366 - protein, 11 aa, Artificial
  IGFBP-2 heparin binding domain-containing peptide sequence
RKKIGVNEPRK

SEQ ID NO: 3367 - protein, 11 aa, Artificial
  IGFBP-2 heparin binding domain-containing peptide sequence
HKKIGVNEPRK

SEQ ID NO: 3368 - protein, 11 aa, Artificial
  IGFBP-2 heparin binding domain-containing peptide sequence
KRKIGVNEPRK

SEQ ID NO: 3369 - protein, 11 aa, Artificial
  IGFBP-2 heparin binding domain-containing peptide sequence
RRKIGVNEPRK

SEQ ID NO: 3370 - protein, 11 aa, Artificial
  IGFBP-2 heparin binding domain-containing peptide sequence
HRKIGVNEPRK

SEQ ID NO: 3371 - protein, 11 aa, Artificial
  IGFBP-2 heparin binding domain-containing peptide sequence
KHRIGVNEPRK

SEQ ID NO: 3372 - protein, 11 aa, Artificial
  IGFBP-2 heparin binding domain-containing peptide sequence
RHRIGVNEPRK

SEQ ID NO: 3373 - protein, 11 aa, Artificial
  IGFBP-2 heparin binding domain-containing peptide sequence
HHRIGVNEPRK

SEQ ID NO: 3374 - protein, 11 aa, Artificial
  IGFBP-2 heparin binding domain-containing peptide sequence
KKRIGVNEPRK

SEQ ID NO: 3375 - protein, 11 aa, Artificial
  IGFBP-2 heparin binding domain-containing peptide sequence
RKRIGVNEPRK

SEQ ID NO: 3376 - protein, 11 aa, Artificial
  IGFBP-2 heparin binding domain-containing peptide sequence
HKRIGVNEPRK

SEQ ID NO: 3377 - protein, 11 aa, Artificial
  IGFBP-2 heparin binding domain-containing peptide sequence
KRRIGVNEPRK

SEQ ID NO: 3378 - protein, 11 aa, Artificial
  IGFBP-2 heparin binding domain-containing peptide sequence
RRRIGVNEPRK

SEQ ID NO: 3379 - protein, 11 aa, Artificial
  IGFBP-2 heparin binding domain-containing peptide sequence
HRRIGVNEPRK

SEQ ID NO: 3380 - protein, 11 aa, Artificial
  IGFBP-2 heparin binding domain-containing peptide sequence
KHHVGVNEPRK

SEQ ID NO: 3381 - protein, 11 aa, Artificial
  IGFBP-2 heparin binding domain-containing peptide sequence
RHHVGVNEPRK

SEQ ID NO: 3382 - protein, 11 aa, Artificial
  IGFBP-2 heparin binding domain-containing peptide sequence
HHHVGVNEPRK

SEQ ID NO: 3383 - protein, 11 aa, Artificial
  IGFBP-2 heparin binding domain-containing peptide sequence
KKHVGVNEPRK

SEQ ID NO: 3384 - protein, 11 aa, Artificial
  IGFBP-2 heparin binding domain-containing peptide sequence
RKHVGVNEPRK

SEQ ID NO: 3385 - protein, 11 aa, Artificial
  IGFBP-2 heparin binding domain-containing peptide sequence
HKHVGVNEPRK

SEQ ID NO: 3386 - protein, 11 aa, Artificial
  IGFBP-2 heparin binding domain-containing peptide sequence
KRHVGVNEPRK

SEQ ID NO: 3387 - protein, 11 aa, Artificial
  IGFBP-2 heparin binding domain-containing peptide sequence
RRHVGVNEPRK

SEQ ID NO: 3388 - protein, 11 aa, Artificial
  IGFBP-2 heparin binding domain-containing peptide sequence
HRHVGVNEPRK

SEQ ID NO: 3389 - protein, 11 aa, Artificial
  IGFBP-2 heparin binding domain-containing peptide sequence
KHKVGVNEPRK

SEQ ID NO: 3390 - protein, 11 aa, Artificial
  IGFBP-2 heparin binding domain-containing peptide sequence
RHKVGVNEPRK

SEQ ID NO: 3391 - protein, 11 aa, Artificial
  IGFBP-2 heparin binding domain-containing peptide sequence
HHKVGVNEPRK

SEQ ID NO: 3392 - protein, 11 aa, Artificial
  IGFBP-2 heparin binding domain-containing peptide sequence
KKKVGVNEPRK

SEQ ID NO: 3393 - protein, 11 aa, Artificial
  IGFBP-2 heparin binding domain-containing peptide sequence
RKKVGVNEPRK

SEQ ID NO: 3394 - protein, 11 aa, Artificial
  IGFBP-2 heparin binding domain-containing peptide sequence
HKKVGVNEPRK

SEQ ID NO: 3395 - protein, 11 aa, Artificial
  IGFBP-2 heparin binding domain-containing peptide sequence
KRKVGVNEPRK

SEQ ID NO: 3396 - protein, 11 aa, Artificial
  IGFBP-2 heparin binding domain-containing peptide sequence
RRKVGVNEPRK

SEQ ID NO: 3397 - protein, 11 aa, Artificial
  IGFBP-2 heparin binding domain-containing peptide sequence
HRKVGVNEPRK

SEQ ID NO: 3398 - protein, 11 aa, Artificial
  IGFBP-2 heparin binding domain-containing peptide sequence
KHRVGVNEPRK

SEQ ID NO: 3399 - protein, 11 aa, Artificial
  IGFBP-2 heparin binding domain-containing peptide sequence
RHRVGVNEPRK

SEQ ID NO: 3400 - protein, 11 aa, Artificial
  IGFBP-2 heparin binding domain-containing peptide sequence
HHRVGVNEPRK

SEQ ID NO: 3401 - protein, 11 aa, Artificial
  IGFBP-2 heparin binding domain-containing peptide sequence
KKRVGVNEPRK

SEQ ID NO: 3402 - protein, 11 aa, Artificial
  IGFBP-2 heparin binding domain-containing peptide sequence
RKRVGVNEPRK

SEQ ID NO: 3403 - protein, 11 aa, Artificial
  IGFBP-2 heparin binding domain-containing peptide sequence
HKRVGVNEPRK

SEQ ID NO: 3404 - protein, 11 aa, Artificial
  IGFBP-2 heparin binding domain-containing peptide sequence
KRRVGVNEPRK

SEQ ID NO: 3405 - protein, 11 aa, Artificial
  IGFBP-2 heparin binding domain-containing peptide sequence
RRRVGVNEPRK

SEQ ID NO: 3406 - protein, 11 aa, Artificial
  IGFBP-2 heparin binding domain-containing peptide sequence
HRRVGVNEPRK

SEQ ID NO: 3407 - protein, 11 aa, Artificial
  IGFBP-2 heparin binding domain-containing peptide sequence
KHHLGLENPRK

SEQ ID NO: 3408 - protein, 11 aa, Artificial
  IGFBP-2 heparin binding domain-containing peptide sequence
RHHLGLENPRK

SEQ ID NO: 3409 - protein, 11 aa, Artificial
  IGFBP-2 heparin binding domain-containing peptide sequence
HHHLGLENPRK

SEQ ID NO: 3410 - protein, 11 aa, Artificial
  IGFBP-2 heparin binding domain-containing peptide sequence
KKHLGLENPRK

SEQ ID NO: 3411 - protein, 11 aa, Artificial
  IGFBP-2 heparin binding domain-containing peptide sequence
RKHLGLENPRK

SEQ ID NO: 3412 - protein, 11 aa, Artificial
  IGFBP-2 heparin binding domain-containing peptide sequence
HKHLGLENPRK

SEQ ID NO: 3413 - protein, 11 aa, Artificial
  IGFBP-2 heparin binding domain-containing peptide sequence
KRHLGLENPRK

SEQ ID NO: 3414 - protein, 11 aa, Artificial
  IGFBP-2 heparin binding domain-containing peptide sequence
RRHLGLENPRK

SEQ ID NO: 3415 - protein, 11 aa, Artificial
  IGFBP-2 heparin binding domain-containing peptide sequence
HRHLGLENPRK

SEQ ID NO: 3416 - protein, 11 aa, Artificial
  IGFBP-2 heparin binding domain-containing peptide sequence
KHKLGLENPRK

SEQ ID NO: 3417 - protein, 11 aa, Artificial
  IGFBP-2 heparin binding domain-containing peptide sequence
RHKLGLENPRK

SEQ ID NO: 3418 - protein, 11 aa, Artificial
  IGFBP-2 heparin binding domain-containing peptide sequence
HHKLGLENPRK

SEQ ID NO: 3419 - protein, 11 aa, Artificial
  IGFBP-2 heparin binding domain-containing peptide sequence
KKKLGLENPRK

SEQ ID NO: 3420 - protein, 11 aa, Artificial
  IGFBP-2 heparin binding domain-containing peptide sequence
RKKLGLENPRK

SEQ ID NO: 3421 - protein, 11 aa, Artificial
  IGFBP-2 heparin binding domain-containing peptide sequence
HKKLGLENPRK

SEQ ID NO: 3422 - protein, 11 aa, Artificial
  IGFBP-2 heparin binding domain-containing peptide sequence
KRKLGLENPRK

SEQ ID NO: 3423 - protein, 11 aa, Artificial
  IGFBP-2 heparin binding domain-containing peptide sequence
RRKLGLENPRK

SEQ ID NO: 3424 - protein, 11 aa, Artificial
  IGFBP-2 heparin binding domain-containing peptide sequence
HRKLGLENPRK

SEQ ID NO: 3425 - protein, 11 aa, Artificial
  IGFBP-2 heparin binding domain-containing peptide sequence
KHRLGLENPRK

SEQ ID NO: 3426 - protein, 11 aa, Artificial
  IGFBP-2 heparin binding domain-containing peptide sequence
RHRLGLENPRK

SEQ ID NO: 3427 - protein, 11 aa, Artificial
  IGFBP-2 heparin binding domain-containing peptide sequence
HHRLGLENPRK

SEQ ID NO: 3428 - protein, 11 aa, Artificial
  IGFBP-2 heparin binding domain-containing peptide sequence
KKRLGLENPRK

SEQ ID NO: 3429 - protein, 11 aa, Artificial
  IGFBP-2 heparin binding domain-containing peptide sequence
RKRLGLENPRK

SEQ ID NO: 3430 - protein, 11 aa, Artificial
  IGFBP-2 heparin binding domain-containing peptide sequence
HKRLGLENPRK

SEQ ID NO: 3431 - protein, 11 aa, Artificial
  IGFBP-2 heparin binding domain-containing peptide sequence
KRRLGLENPRK

SEQ ID NO: 3432 - protein, 11 aa, Artificial
  IGFBP-2 heparin binding domain-containing peptide sequence
RRRLGLENPRK

SEQ ID NO: 3433 - protein, 11 aa, Artificial
  IGFBP-2 heparin binding domain-containing peptide sequence
HRRLGLENPRK

SEQ ID NO: 3434 - protein, 11 aa, Artificial
  IGFBP-2 heparin binding domain-containing peptide sequence
KHHIGLENPRK

SEQ ID NO: 3435 - protein, 11 aa, Artificial
  IGFBP-2 heparin binding domain-containing peptide sequence
RHHIGLENPRK

SEQ ID NO: 3436 - protein, 11 aa, Artificial
  IGFBP-2 heparin binding domain-containing peptide sequence
HHHIGLENPRK

SEQ ID NO: 3437 - protein, 11 aa, Artificial
  IGFBP-2 heparin binding domain-containing peptide sequence
KKHIGLENPRK

SEQ ID NO: 3438 - protein, 11 aa, Artificial
  IGFBP-2 heparin binding domain-containing peptide sequence
RKHIGLENPRK

SEQ ID NO: 3439 - protein, 11 aa, Artificial
  IGFBP-2 heparin binding domain-containing peptide sequence
HKHIGLENPRK

SEQ ID NO: 3440 - protein, 11 aa, Artificial
  IGFBP-2 heparin binding domain-containing peptide sequence
KRHIGLENPRK

SEQ ID NO: 3441 - protein, 11 aa, Artificial
  IGFBP-2 heparin binding domain-containing peptide sequence
RRHIGLENPRK

SEQ ID NO: 3442 - protein, 11 aa, Artificial
  IGFBP-2 heparin binding domain-containing peptide sequence
HRHIGLENPRK

SEQ ID NO: 3443 - protein, 11 aa, Artificial
  IGFBP-2 heparin binding domain-containing peptide sequence
KHKIGLENPRK

SEQ ID NO: 3444 - protein, 11 aa, Artificial
  IGFBP-2 heparin binding domain-containing peptide sequence
RHKIGLENPRK

SEQ ID NO: 3445 - protein, 11 aa, Artificial
  IGFBP-2 heparin binding domain-containing peptide sequence
HHKIGLENPRK

SEQ ID NO: 3446 - protein, 11 aa, Artificial
  IGFBP-2 heparin binding domain-containing peptide sequence
KKKIGLENPRK

SEQ ID NO: 3447 - protein, 11 aa, Artificial
  IGFBP-2 heparin binding domain-containing peptide sequence
RKKIGLENPRK

SEQ ID NO: 3448 - protein, 11 aa, Artificial
  IGFBP-2 heparin binding domain-containing peptide sequence
HKKIGLENPRK

SEQ ID NO: 3449 - protein, 11 aa, Artificial
  IGFBP-2 heparin binding domain-containing peptide sequence
KRKIGLENPRK

SEQ ID NO: 3450 - protein, 11 aa, Artificial
  IGFBP-2 heparin binding domain-containing peptide sequence
RRKIGLENPRK

SEQ ID NO: 3451 - protein, 11 aa, Artificial
  IGFBP-2 heparin binding domain-containing peptide sequence
HRKIGLENPRK

SEQ ID NO: 3452 - protein, 11 aa, Artificial
  IGFBP-2 heparin binding domain-containing peptide sequence
KHRIGLENPRK

SEQ ID NO: 3453 - protein, 11 aa, Artificial
  IGFBP-2 heparin binding domain-containing peptide sequence
RHRIGLENPRK

SEQ ID NO: 3454 - protein, 11 aa, Artificial
  IGFBP-2 heparin binding domain-containing peptide sequence
HHRIGLENPRK

SEQ ID NO: 3455 - protein, 11 aa, Artificial
  IGFBP-2 heparin binding domain-containing peptide sequence
KKRIGLENPRK

SEQ ID NO: 3456 - protein, 11 aa, Artificial
  IGFBP-2 heparin binding domain-containing peptide sequence
RKRIGLENPRK

SEQ ID NO: 3457 - protein, 11 aa, Artificial
  IGFBP-2 heparin binding domain-containing peptide sequence
HKRIGLENPRK

SEQ ID NO: 3458 - protein, 11 aa, Artificial
  IGFBP-2 heparin binding domain-containing peptide sequence
KRRIGLENPRK

SEQ ID NO: 3459 - protein, 11 aa, Artificial
  IGFBP-2 heparin binding domain-containing peptide sequence
RRRIGLENPRK

SEQ ID NO: 3460 - protein, 11 aa, Artificial
  IGFBP-2 heparin binding domain-containing peptide sequence
HRRIGLENPRK

SEQ ID NO: 3461 - protein, 11 aa, Artificial
  IGFBP-2 heparin binding domain-containing peptide sequence
KHHVGLENPRK

SEQ ID NO: 3462 - protein, 11 aa, Artificial
  IGFBP-2 heparin binding domain-containing peptide sequence
RHHVGLENPRK

SEQ ID NO: 3463 - protein, 11 aa, Artificial
  IGFBP-2 heparin binding domain-containing peptide sequence
HHHVGLENPRK

SEQ ID NO: 3464 - protein, 11 aa, Artificial
  IGFBP-2 heparin binding domain-containing peptide sequence
KKHVGLENPRK

SEQ ID NO: 3465 - protein, 11 aa, Artificial
  IGFBP-2 heparin binding domain-containing peptide sequence
RKHVGLENPRK

SEQ ID NO: 3466 - protein, 11 aa, Artificial
  IGFBP-2 heparin binding domain-containing peptide sequence
HKHVGLENPRK

SEQ ID NO: 3467 - protein, 11 aa, Artificial
  IGFBP-2 heparin binding domain-containing peptide sequence
KRHVGLENPRK

SEQ ID NO: 3468 - protein, 11 aa, Artificial
  IGFBP-2 heparin binding domain-containing peptide sequence
RRHVGLENPRK

SEQ ID NO: 3469 - protein, 11 aa, Artificial
  IGFBP-2 heparin binding domain-containing peptide sequence
HRHVGLENPRK

SEQ ID NO: 3470 - protein, 11 aa, Artificial
  IGFBP-2 heparin binding domain-containing peptide sequence
KHKVGLENPRK

SEQ ID NO: 3471 - protein, 11 aa, Artificial
  IGFBP-2 heparin binding domain-containing peptide sequence
RHKVGLENPRK

SEQ ID NO: 3472 - protein, 11 aa, Artificial
  IGFBP-2 heparin binding domain-containing peptide sequence
HHKVGLENPRK

SEQ ID NO: 3473 - protein, 11 aa, Artificial
  IGFBP-2 heparin binding domain-containing peptide sequence
KKKVGLENPRK

SEQ ID NO: 3474 - protein, 11 aa, Artificial
  IGFBP-2 heparin binding domain-containing peptide sequence
RKKVGLENPRK

SEQ ID NO: 3475 - protein, 11 aa, Artificial
  IGFBP-2 heparin binding domain-containing peptide sequence
HKKVGLENPRK

SEQ ID NO: 3476 - protein, 11 aa, Artificial
  IGFBP-2 heparin binding domain-containing peptide sequence
KRKVGLENPRK

SEQ ID NO: 3477 - protein, 11 aa, Artificial
  IGFBP-2 heparin binding domain-containing peptide sequence
RRKVGLENPRK

SEQ ID NO: 3478 - protein, 11 aa, Artificial
  IGFBP-2 heparin binding domain-containing peptide sequence
HRKVGLENPRK

SEQ ID NO: 3479 - protein, 11 aa, Artificial
  IGFBP-2 heparin binding domain-containing peptide sequence
KHRVGLENPRK

SEQ ID NO: 3480 - protein, 11 aa, Artificial
  IGFBP-2 heparin binding domain-containing peptide sequence
RHRVGLENPRK

SEQ ID NO: 3481 - protein, 11 aa, Artificial
  IGFBP-2 heparin binding domain-containing peptide sequence
HHRVGLENPRK

SEQ ID NO: 3482 - protein, 11 aa, Artificial
  IGFBP-2 heparin binding domain-containing peptide sequence
KKRVGLENPRK

SEQ ID NO: 3483 - protein, 11 aa, Artificial
  IGFBP-2 heparin binding domain-containing peptide sequence
RKRVGLENPRK

SEQ ID NO: 3484 - protein, 11 aa, Artificial
  IGFBP-2 heparin binding domain-containing peptide sequence
HKRVGLENPRK

SEQ ID NO: 3485 - protein, 11 aa, Artificial
  IGFBP-2 heparin binding domain-containing peptide sequence
KRRVGLENPRK

SEQ ID NO: 3486 - protein, 11 aa, Artificial
  IGFBP-2 heparin binding domain-containing peptide sequence
RRRVGLENPRK

SEQ ID NO: 3487 - protein, 11 aa, Artificial
  IGFBP-2 heparin binding domain-containing peptide sequence
HRRVGLENPRK

SEQ ID NO: 3488 - protein, 11 aa, Artificial
  IGFBP-2 heparin binding domain-containing peptide sequence
KHHLGIENPRK

SEQ ID NO: 3489 - protein, 11 aa, Artificial
  IGFBP-2 heparin binding domain-containing peptide sequence
RHHLGIENPRK

SEQ ID NO: 3490 - protein, 11 aa, Artificial
  IGFBP-2 heparin binding domain-containing peptide sequence
HHHLGIENPRK

SEQ ID NO: 3491 - protein, 11 aa, Artificial
  IGFBP-2 heparin binding domain-containing peptide sequence
KKHLGIENPRK

SEQ ID NO: 3492 - protein, 11 aa, Artificial
  IGFBP-2 heparin binding domain-containing peptide sequence
RKHLGIENPRK

SEQ ID NO: 3493 - protein, 11 aa, Artificial
  IGFBP-2 heparin binding domain-containing peptide sequence
HKHLGIENPRK

SEQ ID NO: 3494 - protein, 11 aa, Artificial
  IGFBP-2 heparin binding domain-containing peptide sequence
KRHLGIENPRK

SEQ ID NO: 3495 - protein, 11 aa, Artificial
  IGFBP-2 heparin binding domain-containing peptide sequence
RRHLGIENPRK

SEQ ID NO: 3496 - protein, 11 aa, Artificial
  IGFBP-2 heparin binding domain-containing peptide sequence
HRHLGIENPRK

SEQ ID NO: 3497 - protein, 11 aa, Artificial
  IGFBP-2 heparin binding domain-containing peptide sequence
KHKLGIENPRK

SEQ ID NO: 3498 - protein, 11 aa, Artificial
  IGFBP-2 heparin binding domain-containing peptide sequence
RHKLGIENPRK

SEQ ID NO: 3499 - protein, 11 aa, Artificial
  IGFBP-2 heparin binding domain-containing peptide sequence
HHKLGIENPRK

SEQ ID NO: 3500 - protein, 11 aa, Artificial
  IGFBP-2 heparin binding domain-containing peptide sequence
KKKLGIENPRK

SEQ ID NO: 3501 - protein, 11 aa, Artificial
  IGFBP-2 heparin binding domain-containing peptide sequence
RKKLGIENPRK

SEQ ID NO: 3502 - protein, 11 aa, Artificial
  IGFBP-2 heparin binding domain-containing peptide sequence
HKKLGIENPRK

SEQ ID NO: 3503 - protein, 11 aa, Artificial
  IGFBP-2 heparin binding domain-containing peptide sequence
KRKLGIENPRK

SEQ ID NO: 3504 - protein, 11 aa, Artificial
  IGFBP-2 heparin binding domain-containing peptide sequence
RRKLGIENPRK

SEQ ID NO: 3505 - protein, 11 aa, Artificial
  IGFBP-2 heparin binding domain-containing peptide sequence
HRKLGIENPRK

SEQ ID NO: 3506 - protein, 11 aa, Artificial
  IGFBP-2 heparin binding domain-containing peptide sequence
KHRLGIENPRK

SEQ ID NO: 3507 - protein, 11 aa, Artificial
  IGFBP-2 heparin binding domain-containing peptide sequence
RHRLGIENPRK

SEQ ID NO: 3508 - protein, 11 aa, Artificial
  IGFBP-2 heparin binding domain-containing peptide sequence
HHRLGIENPRK

SEQ ID NO: 3509 - protein, 11 aa, Artificial
  IGFBP-2 heparin binding domain-containing peptide sequence
KKRLGIENPRK

SEQ ID NO: 3510 - protein, 11 aa, Artificial
  IGFBP-2 heparin binding domain-containing peptide sequence
RKRLGIENPRK

SEQ ID NO: 3511 - protein, 11 aa, Artificial
  IGFBP-2 heparin binding domain-containing peptide sequence
HKRLGIENPRK

SEQ ID NO: 3512 - protein, 11 aa, Artificial
  IGFBP-2 heparin binding domain-containing peptide sequence
KRRLGIENPRK

SEQ ID NO: 3513 - protein, 11 aa, Artificial
  IGFBP-2 heparin binding domain-containing peptide sequence
RRRLGIENPRK

SEQ ID NO: 3514 - protein, 11 aa, Artificial
  IGFBP-2 heparin binding domain-containing peptide sequence
HRRLGIENPRK

SEQ ID NO: 3515 - protein, 11 aa, Artificial
  IGFBP-2 heparin binding domain-containing peptide sequence
KHHIGIENPRK

SEQ ID NO: 3516 - protein, 11 aa, Artificial
  IGFBP-2 heparin binding domain-containing peptide sequence
RHHIGIENPRK

SEQ ID NO: 3517 - protein, 11 aa, Artificial
  IGFBP-2 heparin binding domain-containing peptide sequence
HHHIGIENPRK

SEQ ID NO: 3518 - protein, 11 aa, Artificial
  IGFBP-2 heparin binding domain-containing peptide sequence
KKHIGIENPRK

SEQ ID NO: 3519 - protein, 11 aa, Artificial
  IGFBP-2 heparin binding domain-containing peptide sequence
RKHIGIENPRK

SEQ ID NO: 3520 - protein, 11 aa, Artificial
  IGFBP-2 heparin binding domain-containing peptide sequence
HKHIGIENPRK

SEQ ID NO: 3521 - protein, 11 aa, Artificial
  IGFBP-2 heparin binding domain-containing peptide sequence
KRHIGIENPRK

SEQ ID NO: 3522 - protein, 11 aa, Artificial
  IGFBP-2 heparin binding domain-containing peptide sequence
RRHIGIENPRK

SEQ ID NO: 3523 - protein, 11 aa, Artificial
  IGFBP-2 heparin binding domain-containing peptide sequence
HRHIGIENPRK

SEQ ID NO: 3524 - protein, 11 aa, Artificial
  IGFBP-2 heparin binding domain-containing peptide sequence
KHKIGIENPRK

SEQ ID NO: 3525 - protein, 11 aa, Artificial
  IGFBP-2 heparin binding domain-containing peptide sequence
RHKIGIENPRK

SEQ ID NO: 3526 - protein, 11 aa, Artificial
  IGFBP-2 heparin binding domain-containing peptide sequence
HHKIGIENPRK

SEQ ID NO: 3527 - protein, 11 aa, Artificial
  IGFBP-2 heparin binding domain-containing peptide sequence
KKKIGIENPRK

SEQ ID NO: 3528 - protein, 11 aa, Artificial
  IGFBP-2 heparin binding domain-containing peptide sequence
RKKIGIENPRK

SEQ ID NO: 3529 - protein, 11 aa, Artificial
  IGFBP-2 heparin binding domain-containing peptide sequence
HKKIGIENPRK

SEQ ID NO: 3530 - protein, 11 aa, Artificial
  IGFBP-2 heparin binding domain-containing peptide sequence
KRKIGIENPRK

SEQ ID NO: 3531 - protein, 11 aa, Artificial
  IGFBP-2 heparin binding domain-containing peptide sequence
RRKIGIENPRK

SEQ ID NO: 3532 - protein, 11 aa, Artificial
  IGFBP-2 heparin binding domain-containing peptide sequence
HRKIGIENPRK

SEQ ID NO: 3533 - protein, 11 aa, Artificial
  IGFBP-2 heparin binding domain-containing peptide sequence
KHRIGIENPRK

SEQ ID NO: 3534 - protein, 11 aa, Artificial
  IGFBP-2 heparin binding domain-containing peptide sequence
RHRIGIENPRK

SEQ ID NO: 3535 - protein, 11 aa, Artificial
  IGFBP-2 heparin binding domain-containing peptide sequence
HHRIGIENPRK

SEQ ID NO: 3536 - protein, 11 aa, Artificial
  IGFBP-2 heparin binding domain-containing peptide sequence
KKRIGIENPRK

SEQ ID NO: 3537 - protein, 11 aa, Artificial
  IGFBP-2 heparin binding domain-containing peptide sequence
RKRIGIENPRK

SEQ ID NO: 3538 - protein, 11 aa, Artificial
  IGFBP-2 heparin binding domain-containing peptide sequence
HKRIGIENPRK

SEQ ID NO: 3539 - protein, 11 aa, Artificial
  IGFBP-2 heparin binding domain-containing peptide sequence
KRRIGIENPRK

SEQ ID NO: 3540 - protein, 11 aa, Artificial
  IGFBP-2 heparin binding domain-containing peptide sequence
RRRIGIENPRK

SEQ ID NO: 3541 - protein, 11 aa, Artificial
  IGFBP-2 heparin binding domain-containing peptide sequence
HRRIGIENPRK

SEQ ID NO: 3542 - protein, 11 aa, Artificial
  IGFBP-2 heparin binding domain-containing peptide sequence
KHHVGIENPRK

SEQ ID NO: 3543 - protein, 11 aa, Artificial
  IGFBP-2 heparin binding domain-containing peptide sequence
RHHVGIENPRK

SEQ ID NO: 3544 - protein, 11 aa, Artificial
  IGFBP-2 heparin binding domain-containing peptide sequence
HHHVGIENPRK

SEQ ID NO: 3545 - protein, 11 aa, Artificial
  IGFBP-2 heparin binding domain-containing peptide sequence
KKHVGIENPRK

SEQ ID NO: 3546 - protein, 11 aa, Artificial
  IGFBP-2 heparin binding domain-containing peptide sequence
RKHVGIENPRK

SEQ ID NO: 3547 - protein, 11 aa, Artificial
  IGFBP-2 heparin binding domain-containing peptide sequence
HKHVGIENPRK

SEQ ID NO: 3548 - protein, 11 aa, Artificial
  IGFBP-2 heparin binding domain-containing peptide sequence
KRHVGIENPRK

SEQ ID NO: 3549 - protein, 11 aa, Artificial
  IGFBP-2 heparin binding domain-containing peptide sequence
RRHVGIENPRK

SEQ ID NO: 3550 - protein, 11 aa, Artificial
  IGFBP-2 heparin binding domain-containing peptide sequence
HRHVGIENPRK

SEQ ID NO: 3551 - protein, 11 aa, Artificial
  IGFBP-2 heparin binding domain-containing peptide sequence
KHKVGIENPRK

SEQ ID NO: 3552 - protein, 11 aa, Artificial
  IGFBP-2 heparin binding domain-containing peptide sequence
RHKVGIENPRK

SEQ ID NO: 3553 - protein, 11 aa, Artificial
  IGFBP-2 heparin binding domain-containing peptide sequence
HHKVGIENPRK

SEQ ID NO: 3554 - protein, 11 aa, Artificial
  IGFBP-2 heparin binding domain-containing peptide sequence
KKKVGIENPRK

SEQ ID NO: 3555 - protein, 11 aa, Artificial
  IGFBP-2 heparin binding domain-containing peptide sequence
RKKVGIENPRK

SEQ ID NO: 3556 - protein, 11 aa, Artificial
  IGFBP-2 heparin binding domain-containing peptide sequence
HKKVGIENPRK

SEQ ID NO: 3557 - protein, 11 aa, Artificial
  IGFBP-2 heparin binding domain-containing peptide sequence
KRKVGIENPRK

SEQ ID NO: 3558 - protein, 11 aa, Artificial
  IGFBP-2 heparin binding domain-containing peptide sequence
RRKVGIENPRK

SEQ ID NO: 3559 - protein, 11 aa, Artificial
  IGFBP-2 heparin binding domain-containing peptide sequence
HRKVGIENPRK

SEQ ID NO: 3560 - protein, 11 aa, Artificial
  IGFBP-2 heparin binding domain-containing peptide sequence
KHRVGIENPRK

SEQ ID NO: 3561 - protein, 11 aa, Artificial
  IGFBP-2 heparin binding domain-containing peptide sequence
RHRVGIENPRK

SEQ ID NO: 3562 - protein, 11 aa, Artificial
  IGFBP-2 heparin binding domain-containing peptide sequence
HHRVGIENPRK

SEQ ID NO: 3563 - protein, 11 aa, Artificial
  IGFBP-2 heparin binding domain-containing peptide sequence
KKRVGIENPRK

SEQ ID NO: 3564 - protein, 11 aa, Artificial
  IGFBP-2 heparin binding domain-containing peptide sequence
RKRVGIENPRK

SEQ ID NO: 3565 - protein, 11 aa, Artificial
  IGFBP-2 heparin binding domain-containing peptide sequence
HKRVGIENPRK

SEQ ID NO: 3566 - protein, 11 aa, Artificial
  IGFBP-2 heparin binding domain-containing peptide sequence
KRRVGIENPRK

SEQ ID NO: 3567 - protein, 11 aa, Artificial
  IGFBP-2 heparin binding domain-containing peptide sequence
RRRVGIENPRK

SEQ ID NO: 3568 - protein, 11 aa, Artificial
  IGFBP-2 heparin binding domain-containing peptide sequence
HRRVGIENPRK

SEQ ID NO: 3569 - protein, 11 aa, Artificial
  IGFBP-2 heparin binding domain-containing peptide sequence
KHHLGVENPRK

SEQ ID NO: 3570 - protein, 11 aa, Artificial
  IGFBP-2 heparin binding domain-containing peptide sequence
RHHLGVENPRK

SEQ ID NO: 3571 - protein, 11 aa, Artificial
  IGFBP-2 heparin binding domain-containing peptide sequence
HHHLGVENPRK

SEQ ID NO: 3572 - protein, 11 aa, Artificial
  IGFBP-2 heparin binding domain-containing peptide sequence
KKHLGVENPRK

SEQ ID NO: 3573 - protein, 11 aa, Artificial
  IGFBP-2 heparin binding domain-containing peptide sequence
RKHLGVENPRK

SEQ ID NO: 3574 - protein, 11 aa, Artificial
  IGFBP-2 heparin binding domain-containing peptide sequence
HKHLGVENPRK

SEQ ID NO: 3575 - protein, 11 aa, Artificial
  IGFBP-2 heparin binding domain-containing peptide sequence
KRHLGVENPRK

SEQ ID NO: 3576 - protein, 11 aa, Artificial
  IGFBP-2 heparin binding domain-containing peptide sequence
RRHLGVENPRK

SEQ ID NO: 3577 - protein, 11 aa, Artificial
  IGFBP-2 heparin binding domain-containing peptide sequence
HRHLGVENPRK

SEQ ID NO: 3578 - protein, 11 aa, Artificial
  IGFBP-2 heparin binding domain-containing peptide sequence
KHKLGVENPRK

SEQ ID NO: 3579 - protein, 11 aa, Artificial
  IGFBP-2 heparin binding domain-containing peptide sequence
RHKLGVENPRK

SEQ ID NO: 3580 - protein, 11 aa, Artificial
  IGFBP-2 heparin binding domain-containing peptide sequence
HHKLGVENPRK

SEQ ID NO: 3581 - protein, 11 aa, Artificial
  IGFBP-2 heparin binding domain-containing peptide sequence
KKKLGVENPRK

SEQ ID NO: 3582 - protein, 11 aa, Artificial
  IGFBP-2 heparin binding domain-containing peptide sequence
RKKLGVENPRK

SEQ ID NO: 3583 - protein, 11 aa, Artificial
  IGFBP-2 heparin binding domain-containing peptide sequence
HKKLGVENPRK

SEQ ID NO: 3584 - protein, 11 aa, Artificial
  IGFBP-2 heparin binding domain-containing peptide sequence
KRKLGVENPRK

SEQ ID NO: 3585 - protein, 11 aa, Artificial
  IGFBP-2 heparin binding domain-containing peptide sequence
RRKLGVENPRK

SEQ ID NO: 3586 - protein, 11 aa, Artificial
  IGFBP-2 heparin binding domain-containing peptide sequence
HRKLGVENPRK

SEQ ID NO: 3587 - protein, 11 aa, Artificial
  IGFBP-2 heparin binding domain-containing peptide sequence
KHRLGVENPRK

SEQ ID NO: 3588 - protein, 11 aa, Artificial
  IGFBP-2 heparin binding domain-containing peptide sequence
RHRLGVENPRK

SEQ ID NO: 3589 - protein, 11 aa, Artificial
  IGFBP-2 heparin binding domain-containing peptide sequence
HHRLGVENPRK

SEQ ID NO: 3590 - protein, 11 aa, Artificial
  IGFBP-2 heparin binding domain-containing peptide sequence
KKRLGVENPRK

SEQ ID NO: 3591 - protein, 11 aa, Artificial
  IGFBP-2 heparin binding domain-containing peptide sequence
RKRLGVENPRK

SEQ ID NO: 3592 - protein, 11 aa, Artificial
  IGFBP-2 heparin binding domain-containing peptide sequence
HKRLGVENPRK

SEQ ID NO: 3593 - protein, 11 aa, Artificial
  IGFBP-2 heparin binding domain-containing peptide sequence
KRRLGVENPRK

SEQ ID NO: 3594 - protein, 11 aa, Artificial
  IGFBP-2 heparin binding domain-containing peptide sequence
RRRLGVENPRK

SEQ ID NO: 3595 - protein, 11 aa, Artificial
  IGFBP-2 heparin binding domain-containing peptide sequence
HRRLGVENPRK

SEQ ID NO: 3596 - protein, 11 aa, Artificial
  IGFBP-2 heparin binding domain-containing peptide sequence
KHHIGVENPRK

SEQ ID NO: 3597 - protein, 11 aa, Artificial
  IGFBP-2 heparin binding domain-containing peptide sequence
RHHIGVEEPRK

SEQ ID NO: 3598 - protein, 11 aa, Artificial
  IGFBP-2 heparin binding domain-containing peptide sequence
HHHIGVENPRK

SEQ ID NO: 3599 - protein, 11 aa, Artificial
  IGFBP-2 heparin binding domain-containing peptide sequence
KKHIGVENPRK

SEQ ID NO: 3600 - protein, 11 aa, Artificial
  IGFBP-2 heparin binding domain-containing peptide sequence
RKHIGVENPRK

SEQ ID NO: 3601 - protein, 11 aa, Artificial
  IGFBP-2 heparin binding domain-containing peptide sequence
HKHIGVENPRK

SEQ ID NO: 3602 - protein, 11 aa, Artificial
  IGFBP-2 heparin binding domain-containing peptide sequence
KRHIGVENPRK

SEQ ID NO: 3603 - protein, 11 aa, Artificial
  IGFBP-2 heparin binding domain-containing peptide sequence
RRHIGVENPRK

SEQ ID NO: 3604 - protein, 11 aa, Artificial
  IGFBP-2 heparin binding domain-containing peptide sequence
HRHIGVENPRK

SEQ ID NO: 3605 - protein, 11 aa, Artificial
  IGFBP-2 heparin binding domain-containing peptide sequence
KHKIGVENPRK

SEQ ID NO: 3606 - protein, 11 aa, Artificial
  IGFBP-2 heparin binding domain-containing peptide sequence
RHKIGVENPRK

SEQ ID NO: 3607 - protein, 11 aa, Artificial
  IGFBP-2 heparin binding domain-containing peptide sequence
HHKIGVENPRK

SEQ ID NO: 3608 - protein, 11 aa, Artificial
  IGFBP-2 heparin binding domain-containing peptide sequence
KKKIGVENPRK

SEQ ID NO: 3609 - protein, 11 aa, Artificial
  IGFBP-2 heparin binding domain-containing peptide sequence
RKKIGVENPRK

SEQ ID NO: 3610 - protein, 11 aa, Artificial
  IGFBP-2 heparin binding domain-containing peptide sequence
HKKIGVENPRK

SEQ ID NO: 3611 - protein, 11 aa, Artificial
  IGFBP-2 heparin binding domain-containing peptide sequence
KRKIGVENPRK

SEQ ID NO: 3612 - protein, 11 aa, Artificial
  IGFBP-2 heparin binding domain-containing peptide sequence
RRKIGVENPRK

SEQ ID NO: 3613 - protein, 11 aa, Artificial
  IGFBP-2 heparin binding domain-containing peptide sequence
HRKIGVENPRK

SEQ ID NO: 3614 - protein, 11 aa, Artificial
  IGFBP-2 heparin binding domain-containing peptide sequence
KHRIGVENPRK

SEQ ID NO: 3615 - protein, 11 aa, Artificial
  IGFBP-2 heparin binding domain-containing peptide sequence
RHRIGVENPRK

SEQ ID NO: 3616 - protein, 11 aa, Artificial
  IGFBP-2 heparin binding domain-containing peptide sequence
HHRIGVENPRK

SEQ ID NO: 3617 - protein, 11 aa, Artificial
  IGFBP-2 heparin binding domain-containing peptide sequence
KKRIGVENPRK

SEQ ID NO: 3618 - protein, 11 aa, Artificial
  IGFBP-2 heparin binding domain-containing peptide sequence
RKRIGVENPRK

SEQ ID NO: 3619 - protein, 11 aa, Artificial
  IGFBP-2 heparin binding domain-containing peptide sequence
HKRIGVENPRK

SEQ ID NO: 3620 - protein, 11 aa, Artificial
  IGFBP-2 heparin binding domain-containing peptide sequence
KRRIGVENPRK

SEQ ID NO: 3621 - protein, 11 aa, Artificial
  IGFBP-2 heparin binding domain-containing peptide sequence
RRRIGVENPRK

SEQ ID NO: 3622 - protein, 11 aa, Artificial
  IGFBP-2 heparin binding domain-containing peptide sequence
HRRIGVENPRK

SEQ ID NO: 3623 - protein, 11 aa, Artificial
  IGFBP-2 heparin binding domain-containing peptide sequence
KHHVGVENPRK

SEQ ID NO: 3624 - protein, 11 aa, Artificial
  IGFBP-2 heparin binding domain-containing peptide sequence
RHHVGVENPRK

SEQ ID NO: 3625 - protein, 11 aa, Artificial
  IGFBP-2 heparin binding domain-containing peptide sequence
HHHVGVENPRK

SEQ ID NO: 3626 - protein, 11 aa, Artificial
  IGFBP-2 heparin binding domain-containing peptide sequence
KKHVGVENPRK

SEQ ID NO: 3627 - protein, 11 aa, Artificial
  IGFBP-2 heparin binding domain-containing peptide sequence
RKHVGVENPRK

SEQ ID NO: 3628 - protein, 11 aa, Artificial
  IGFBP-2 heparin binding domain-containing peptide sequence
HKHVGVENPRK

SEQ ID NO: 3629 - protein, 11 aa, Artificial
  IGFBP-2 heparin binding domain-containing peptide sequence
KRHVGVENPRK

SEQ ID NO: 3630 - protein, 11 aa, Artificial
  IGFBP-2 heparin binding domain-containing peptide sequence
RRHVGVENPRK

SEQ ID NO: 3631 - protein, 11 aa, Artificial
  IGFBP-2 heparin binding domain-containing peptide sequence
HRHVGVENPRK

SEQ ID NO: 3632 - protein, 11 aa, Artificial
  IGFBP-2 heparin binding domain-containing peptide sequence
KHKVGVENPRK

SEQ ID NO: 3633 - protein, 11 aa, Artificial
  IGFBP-2 heparin binding domain-containing peptide sequence
RHKVGVENPRK

SEQ ID NO: 3634 - protein, 11 aa, Artificial
  IGFBP-2 heparin binding domain-containing peptide sequence
HHKVGVENPRK

SEQ ID NO: 3635 - protein, 11 aa, Artificial
  IGFBP-2 heparin binding domain-containing peptide sequence
KKKVGVENPRK

SEQ ID NO: 3636 - protein, 11 aa, Artificial
  IGFBP-2 heparin binding domain-containing peptide sequence
RKKVGVENPRK

SEQ ID NO: 3637 - protein, 11 aa, Artificial
  IGFBP-2 heparin binding domain-containing peptide sequence
HKKVGVENPRK

SEQ ID NO: 3638 - protein, 11 aa, Artificial
  IGFBP-2 heparin binding domain-containing peptide sequence
KRKVGVENPRK

SEQ ID NO: 3639 - protein, 11 aa, Artificial
  IGFBP-2 heparin binding domain-containing peptide sequence
RRKVGVEEPRK

SEQ ID NO: 3640 - protein, 11 aa, Artificial
  IGFBP-2 heparin binding domain-containing peptide sequence
HRKVGVENPRK

SEQ ID NO: 3641 - protein, 11 aa, Artificial
  IGFBP-2 heparin binding domain-containing peptide sequence
KHRVGVENPRK

SEQ ID NO: 3642 - protein, 11 aa, Artificial
  IGFBP-2 heparin binding domain-containing peptide sequence
RHRVGVENPRK

SEQ ID NO: 3643 - protein, 11 aa, Artificial
  IGFBP-2 heparin binding domain-containing peptide sequence
HHRVGVENPRK

SEQ ID NO: 3644 - protein, 11 aa, Artificial
  IGFBP-2 heparin binding domain-containing peptide sequence
KKRVGVENPRK

SEQ ID NO: 3645 - protein, 11 aa, Artificial
  IGFBP-2 heparin binding domain-containing peptide sequence
RKRVGVENPRK

SEQ ID NO: 3646 - protein, 11 aa, Artificial
  IGFBP-2 heparin binding domain-containing peptide sequence
HKRVGVENPRK

SEQ ID NO: 3647 - protein, 11 aa, Artificial
  IGFBP-2 heparin binding domain-containing peptide sequence
KRRVGVENPRK

SEQ ID NO: 3648 - protein, 11 aa, Artificial
  IGFBP-2 heparin binding domain-containing peptide sequence
RRRVGVENPRK

SEQ ID NO: 3649 - protein, 11 aa, Artificial
  IGFBP-2 heparin binding domain-containing peptide sequence
HRRVGVENPRK

SEQ ID NO: 3650 - protein, 11 aa, Artificial
  IGFBP-2 heparin binding domain-containing peptide sequence
KHHLGLNNPRK

SEQ ID NO: 3651 - protein, 11 aa, Artificial
  IGFBP-2 heparin binding domain-containing peptide sequence
RHHLGLNNPRK

SEQ ID NO: 3652 - protein, 11 aa, Artificial
  IGFBP-2 heparin binding domain-containing peptide sequence
HHHLGLNNPRK

SEQ ID NO: 3653 - protein, 11 aa, Artificial
  IGFBP-2 heparin binding domain-containing peptide sequence
KKHLGLNNPRK

SEQ ID NO: 3654 - protein, 11 aa, Artificial
  IGFBP-2 heparin binding domain-containing peptide sequence
RKHLGLNNPRK

SEQ ID NO: 3655 - protein, 11 aa, Artificial
  IGFBP-2 heparin binding domain-containing peptide sequence
HKHLGLNNPRK

SEQ ID NO: 3656 - protein, 11 aa, Artificial
  IGFBP-2 heparin binding domain-containing peptide sequence
KRHLGLNNPRK

SEQ ID NO: 3657 - protein, 11 aa, Artificial
  IGFBP-2 heparin binding domain-containing peptide sequence
RRHLGLNNPRK

SEQ ID NO: 3658 - protein, 11 aa, Artificial
  IGFBP-2 heparin binding domain-containing peptide sequence
HRHLGLNNPRK

SEQ ID NO: 3659 - protein, 11 aa, Artificial
  IGFBP-2 heparin binding domain-containing peptide sequence
KHKLGLNNPRK

SEQ ID NO: 3660 - protein, 11 aa, Artificial
  IGFBP-2 heparin binding domain-containing peptide sequence
RHKLGLNNPRK

SEQ ID NO: 3661 - protein, 11 aa, Artificial
  IGFBP-2 heparin binding domain-containing peptide sequence
HHKLGLNNPRK

SEQ ID NO: 3662 - protein, 11 aa, Artificial
  IGFBP-2 heparin binding domain-containing peptide sequence
KKKLGLNNPRK

SEQ ID NO: 3663 - protein, 11 aa, Artificial
  IGFBP-2 heparin binding domain-containing peptide sequence
RKKLGLNNPRK

SEQ ID NO: 3664 - protein, 11 aa, Artificial
  IGFBP-2 heparin binding domain-containing peptide sequence
HKKLGLNNPRK

SEQ ID NO: 3665 - protein, 11 aa, Artificial
  IGFBP-2 heparin binding domain-containing peptide sequence
KRKLGLNNPRK

SEQ ID NO: 3666 - protein, 11 aa, Artificial
  IGFBP-2 heparin binding domain-containing peptide sequence
RRKLGLNNPRK

SEQ ID NO: 3667 - protein, 11 aa, Artificial
  IGFBP-2 heparin binding domain-containing peptide sequence
HRKLGLNNPRK

SEQ ID NO: 3668 - protein, 11 aa, Artificial
  IGFBP-2 heparin binding domain-containing peptide sequence
KHRLGLNNPRK

SEQ ID NO: 3669 - protein, 11 aa, Artificial
  IGFBP-2 heparin binding domain-containing peptide sequence
RHRLGLNNPRK

SEQ ID NO: 3670 - protein, 11 aa, Artificial
  IGFBP-2 heparin binding domain-containing peptide sequence
HHRLGLNNPRK

SEQ ID NO: 3671 - protein, 11 aa, Artificial
  IGFBP-2 heparin binding domain-containing peptide sequence
KKRLGLNNPRK

SEQ ID NO: 3672 - protein, 11 aa, Artificial
  IGFBP-2 heparin binding domain-containing peptide sequence
RKRLGLNNPRK

SEQ ID NO: 3673 - protein, 11 aa, Artificial
  IGFBP-2 heparin binding domain-containing peptide sequence
HKRLGLNNPRK

SEQ ID NO: 3674 - protein, 11 aa, Artificial
  IGFBP-2 heparin binding domain-containing peptide sequence
KRRLGLNNPRK

SEQ ID NO: 3675 - protein, 11 aa, Artificial
  IGFBP-2 heparin binding domain-containing peptide sequence
RRRLGLNNPRK

SEQ ID NO: 3676 - protein, 11 aa, Artificial
  IGFBP-2 heparin binding domain-containing peptide sequence
HRRLGLNNPRK

SEQ ID NO: 3677 - protein, 11 aa, Artificial
  IGFBP-2 heparin binding domain-containing peptide sequence
KHHIGLNNPRK

SEQ ID NO: 3678 - protein, 11 aa, Artificial
  IGFBP-2 heparin binding domain-containing peptide sequence
RHHIGLNNPRK

SEQ ID NO: 3679 - protein, 11 aa, Artificial
  IGFBP-2 heparin binding domain-containing peptide sequence
HHHIGLNNPRK

SEQ ID NO: 3680 - protein, 11 aa, Artificial
  IGFBP-2 heparin binding domain-containing peptide sequence
KKHIGLNNPRK

SEQ ID NO: 3681 - protein, 11 aa, Artificial
  IGFBP-2 heparin binding domain-containing peptide sequence
RKHIGLNNPRK

SEQ ID NO: 3682 - protein, 11 aa, Artificial
  IGFBP-2 heparin binding domain-containing peptide sequence
HKHIGLNNPRK

SEQ ID NO: 3683 - protein, 11 aa, Artificial
  IGFBP-2 heparin binding domain-containing peptide sequence
KRHIGLNNPRK

SEQ ID NO: 3684 - protein, 11 aa, Artificial
  IGFBP-2 heparin binding domain-containing peptide sequence
RRHIGLNNPRK

SEQ ID NO: 3685 - protein, 11 aa, Artificial
  IGFBP-2 heparin binding domain-containing peptide sequence
HRHIGLNNPRK

SEQ ID NO: 3686 - protein, 11 aa, Artificial
  IGFBP-2 heparin binding domain-containing peptide sequence
KHKIGLNNPRK

SEQ ID NO: 3687 - protein, 11 aa, Artificial
  IGFBP-2 heparin binding domain-containing peptide sequence
RHKIGLNNPRK

SEQ ID NO: 3688 - protein, 11 aa, Artificial
  IGFBP-2 heparin binding domain-containing peptide sequence
HHKIGLNNPRK

SEQ ID NO: 3689 - protein, 11 aa, Artificial
  IGFBP-2 heparin binding domain-containing peptide sequence
KKKIGLNNPRK

SEQ ID NO: 3690 - protein, 11 aa, Artificial
  IGFBP-2 heparin binding domain-containing peptide sequence
RKKIGLNNPRK

SEQ ID NO: 3691 - protein, 11 aa, Artificial
  IGFBP-2 heparin binding domain-containing peptide sequence
HKKIGLNNPRK

SEQ ID NO: 3692 - protein, 11 aa, Artificial
  IGFBP-2 heparin binding domain-containing peptide sequence
KRKIGLNNPRK

SEQ ID NO: 3693 - protein, 11 aa, Artificial
  IGFBP-2 heparin binding domain-containing peptide sequence
RRKIGLNNPRK

SEQ ID NO: 3694 - protein, 11 aa, Artificial
  IGFBP-2 heparin binding domain-containing peptide sequence
HRKIGLNNPRK

SEQ ID NO: 3695 - protein, 11 aa, Artificial
  IGFBP-2 heparin binding domain-containing peptide sequence
KHRIGLNNPRK

SEQ ID NO: 3696 - protein, 11 aa, Artificial
  IGFBP-2 heparin binding domain-containing peptide sequence
RHRIGLNNPRK

SEQ ID NO: 3697 - protein, 11 aa, Artificial
  IGFBP-2 heparin binding domain-containing peptide sequence
HHRIGLNNPRK

SEQ ID NO: 3698 - protein, 11 aa, Artificial
  IGFBP-2 heparin binding domain-containing peptide sequence
KKRIGLNNPRK

SEQ ID NO: 3699 - protein, 11 aa, Artificial
  IGFBP-2 heparin binding domain-containing peptide sequence
RKRIGLNNPRK

SEQ ID NO: 3700 - protein, 11 aa, Artificial
  IGFBP-2 heparin binding domain-containing peptide sequence
HKRIGLNNPRK

SEQ ID NO: 3701 - protein, 11 aa, Artificial
  IGFBP-2 heparin binding domain-containing peptide sequence
KRRIGLNNPRK

SEQ ID NO: 3702 - protein, 11 aa, Artificial
  IGFBP-2 heparin binding domain-containing peptide sequence
RRRIGLNNPRK

SEQ ID NO: 3703 - protein, 11 aa, Artificial
  IGFBP-2 heparin binding domain-containing peptide sequence
HRRIGLNNPRK

SEQ ID NO: 3704 - protein, 11 aa, Artificial
  IGFBP-2 heparin binding domain-containing peptide sequence
KHHVGLNNPRK

SEQ ID NO: 3705 - protein, 11 aa, Artificial
  IGFBP-2 heparin binding domain-containing peptide sequence
RHHVGLNNPRK

SEQ ID NO: 3706 - protein, 11 aa, Artificial
  IGFBP-2 heparin binding domain-containing peptide sequence
HHHVGLNNPRK

SEQ ID NO: 3707 - protein, 11 aa, Artificial
  IGFBP-2 heparin binding domain-containing peptide sequence
KKHVGLNNPRK

SEQ ID NO: 3708 - protein, 11 aa, Artificial
  IGFBP-2 heparin binding domain-containing peptide sequence
RKHVGLNNPRK

SEQ ID NO: 3709 - protein, 11 aa, Artificial
  IGFBP-2 heparin binding domain-containing peptide sequence
HKHVGLNNPRK

SEQ ID NO: 3710 - protein, 11 aa, Artificial
  IGFBP-2 heparin binding domain-containing peptide sequence
KRHVGLNNPRK

SEQ ID NO: 3711 - protein, 11 aa, Artificial
  IGFBP-2 heparin binding domain-containing peptide sequence
RRHVGLNNPRK

SEQ ID NO: 3712 - protein, 11 aa, Artificial
  IGFBP-2 heparin binding domain-containing peptide sequence
HRHVGLNNPRK

SEQ ID NO: 3713 - protein, 11 aa, Artificial
  IGFBP-2 heparin binding domain-containing peptide sequence
KHKVGLNNPRK

SEQ ID NO: 3714 - protein, 11 aa, Artificial
  IGFBP-2 heparin binding domain-containing peptide sequence
RHKVGLNNPRK

SEQ ID NO: 3715 - protein, 11 aa, Artificial
  IGFBP-2 heparin binding domain-containing peptide sequence
HHKVGLNNPRK

SEQ ID NO: 3716 - protein, 11 aa, Artificial
  IGFBP-2 heparin binding domain-containing peptide sequence
KKKVGLNNPRK

SEQ ID NO: 3717 - protein, 11 aa, Artificial
  IGFBP-2 heparin binding domain-containing peptide sequence
RKKVGLNNPRK

SEQ ID NO: 3718 - protein, 11 aa, Artificial
  IGFBP-2 heparin binding domain-containing peptide sequence
HKKVGLNNPRK

SEQ ID NO: 3719 - protein, 11 aa, Artificial
  IGFBP-2 heparin binding domain-containing peptide sequence
KRKVGLNNPRK

SEQ ID NO: 3720 - protein, 11 aa, Artificial
  IGFBP-2 heparin binding domain-containing peptide sequence
RRKVGLNNPRK

SEQ ID NO: 3721 - protein, 11 aa, Artificial
  IGFBP-2 heparin binding domain-containing peptide sequence
HRKVGLNNPRK

SEQ ID NO: 3722 - protein, 11 aa, Artificial
  IGFBP-2 heparin binding domain-containing peptide sequence
KHRVGLNNPRK

SEQ ID NO: 3723 - protein, 11 aa, Artificial
  IGFBP-2 heparin binding domain-containing peptide sequence
RHRVGLNNPRK

SEQ ID NO: 3724 - protein, 11 aa, Artificial
  IGFBP-2 heparin binding domain-containing peptide sequence
HHRVGLNNPRK

SEQ ID NO: 3725 - protein, 11 aa, Artificial
  IGFBP-2 heparin binding domain-containing peptide sequence
KKRVGLNNPRK

SEQ ID NO: 3726 - protein, 11 aa, Artificial
  IGFBP-2 heparin binding domain-containing peptide sequence
RKRVGLNNPRK

SEQ ID NO: 3727 - protein, 11 aa, Artificial
  IGFBP-2 heparin binding domain-containing peptide sequence
HKRVGLNNPRK

SEQ ID NO: 3728 - protein, 11 aa, Artificial
  IGFBP-2 heparin binding domain-containing peptide sequence
KRRVGLNNPRK

SEQ ID NO: 3729 - protein, 11 aa, Artificial
  IGFBP-2 heparin binding domain-containing peptide sequence
RRRVGLNNPRK

SEQ ID NO: 3730 - protein, 11 aa, Artificial
  IGFBP-2 heparin binding domain-containing peptide sequence
HRRVGLNNPRK

SEQ ID NO: 3731 - protein, 11 aa, Artificial
  IGFBP-2 heparin binding domain-containing peptide sequence
KHHLGINNPRK

SEQ ID NO: 3732 - protein, 11 aa, Artificial
  IGFBP-2 heparin binding domain-containing peptide sequence
RHHLGINNPRK

SEQ ID NO: 3733 - protein, 11 aa, Artificial
  IGFBP-2 heparin binding domain-containing peptide sequence
HHHLGINNPRK

SEQ ID NO: 3734 - protein, 11 aa, Artificial
  IGFBP-2 heparin binding domain-containing peptide sequence
KKHLGINNPRK

SEQ ID NO: 3735 - protein, 11 aa, Artificial
  IGFBP-2 heparin binding domain-containing peptide sequence
RKHLGINNPRK

SEQ ID NO: 3736 - protein, 11 aa, Artificial
  IGFBP-2 heparin binding domain-containing peptide sequence
HKHLGINNPRK

SEQ ID NO: 3737 - protein, 11 aa, Artificial
  IGFBP-2 heparin binding domain-containing peptide sequence
KRHLGINNPRK

SEQ ID NO: 3738 - protein, 11 aa, Artificial
  IGFBP-2 heparin binding domain-containing peptide sequence
RRHLGINNPRK

SEQ ID NO: 3739 - protein, 11 aa, Artificial
  IGFBP-2 heparin binding domain-containing peptide sequence
HRHLGINNPRK

SEQ ID NO: 3740 - protein, 11 aa, Artificial
  IGFBP-2 heparin binding domain-containing peptide sequence
KHKLGINNPRK

SEQ ID NO: 3741 - protein, 11 aa, Artificial
  IGFBP-2 heparin binding domain-containing peptide sequence
RHKLGINNPRK

SEQ ID NO: 3742 - protein, 11 aa, Artificial
  IGFBP-2 heparin binding domain-containing peptide sequence
HHKLGINNPRK

SEQ ID NO: 3743 - protein, 11 aa, Artificial
  IGFBP-2 heparin binding domain-containing peptide sequence
KKKLGINNPRK

SEQ ID NO: 3744 - protein, 11 aa, Artificial
  IGFBP-2 heparin binding domain-containing peptide sequence
RKKLGINNPRK

SEQ ID NO: 3745 - protein, 11 aa, Artificial
  IGFBP-2 heparin binding domain-containing peptide sequence
HKKLGINNPRK

SEQ ID NO: 3746 - protein, 11 aa, Artificial
  IGFBP-2 heparin binding domain-containing peptide sequence
KRKLGINNPRK

SEQ ID NO: 3747 - protein, 11 aa, Artificial
  IGFBP-2 heparin binding domain-containing peptide sequence
RRKLGINNPRK

SEQ ID NO: 3748 - protein, 11 aa, Artificial
  IGFBP-2 heparin binding domain-containing peptide sequence
HRKLGINNPRK

SEQ ID NO: 3749 - protein, 11 aa, Artificial
  IGFBP-2 heparin binding domain-containing peptide sequence
KHRLGINNPRK

SEQ ID NO: 3750 - protein, 11 aa, Artificial
  IGFBP-2 heparin binding domain-containing peptide sequence
RHRLGINNPRK

SEQ ID NO: 3751 - protein, 11 aa, Artificial
  IGFBP-2 heparin binding domain-containing peptide sequence
HHRLGINNPRK

SEQ ID NO: 3752 - protein, 11 aa, Artificial
  IGFBP-2 heparin binding domain-containing peptide sequence
KKRLGINNPRK

SEQ ID NO: 3753 - protein, 11 aa, Artificial
  IGFBP-2 heparin binding domain-containing peptide sequence
RKRLGINNPRK

SEQ ID NO: 3754 - protein, 11 aa, Artificial
  IGFBP-2 heparin binding domain-containing peptide sequence
HKRLGINNPRK

SEQ ID NO: 3755 - protein, 11 aa, Artificial
  IGFBP-2 heparin binding domain-containing peptide sequence
KRRLGINNPRK

SEQ ID NO: 3756 - protein, 11 aa, Artificial
  IGFBP-2 heparin binding domain-containing peptide sequence
RRRLGINNPRK

SEQ ID NO: 3757 - protein, 11 aa, Artificial
  IGFBP-2 heparin binding domain-containing peptide sequence
HRRLGINNPRK

SEQ ID NO: 3758 - protein, 11 aa, Artificial
  IGFBP-2 heparin binding domain-containing peptide sequence
KHHIGIENPRK

SEQ ID NO: 3759 - protein, 11 aa, Artificial
  IGFBP-2 heparin binding domain-containing peptide sequence
RHHIGINNPRK

SEQ ID NO: 3760 - protein, 11 aa, Artificial
  IGFBP-2 heparin binding domain-containing peptide sequence
HHHIGINNPRK

SEQ ID NO: 3761 - protein, 11 aa, Artificial
  IGFBP-2 heparin binding domain-containing peptide sequence
KKHIGINNPRK

SEQ ID NO: 3762 - protein, 11 aa, Artificial
  IGFBP-2 heparin binding domain-containing peptide sequence
RKHIGINNPRK

SEQ ID NO: 3763 - protein, 11 aa, Artificial
  IGFBP-2 heparin binding domain-containing peptide sequence
HKHIGINNPRK

SEQ ID NO: 3764 - protein, 11 aa, Artificial
  IGFBP-2 heparin binding domain-containing peptide sequence
KRHIGINNPRK

SEQ ID NO: 3765 - protein, 11 aa, Artificial
  IGFBP-2 heparin binding domain-containing peptide sequence
RRHIGINNPRK

SEQ ID NO: 3766 - protein, 11 aa, Artificial
  IGFBP-2 heparin binding domain-containing peptide sequence
HRHIGINNPRK

SEQ ID NO: 3767 - protein, 11 aa, Artificial
  IGFBP-2 heparin binding domain-containing peptide sequence
KHKIGINNPRK

SEQ ID NO: 3768 - protein, 11 aa, Artificial
  IGFBP-2 heparin binding domain-containing peptide sequence
RHKIGINNPRK

SEQ ID NO: 3769 - protein, 11 aa, Artificial
  IGFBP-2 heparin binding domain-containing peptide sequence
HHKIGINNPRK

SEQ ID NO: 3770 - protein, 11 aa, Artificial
  IGFBP-2 heparin binding domain-containing peptide sequence
KKKIGINNPRK

SEQ ID NO: 3771 - protein, 11 aa, Artificial
  IGFBP-2 heparin binding domain-containing peptide sequence
RKKIGINNPRK

SEQ ID NO: 3772 - protein, 11 aa, Artificial
  IGFBP-2 heparin binding domain-containing peptide sequence
HKKIGINNPRK

SEQ ID NO: 3773 - protein, 11 aa, Artificial
  IGFBP-2 heparin binding domain-containing peptide sequence
KRKIGINNPRK

SEQ ID NO: 3774 - protein, 11 aa, Artificial
  IGFBP-2 heparin binding domain-containing peptide sequence
RRKIGINNPRK

SEQ ID NO: 3775 - protein, 11 aa, Artificial
  IGFBP-2 heparin binding domain-containing peptide sequence
HRKIGINNPRK

SEQ ID NO: 3776 - protein, 11 aa, Artificial
  IGFBP-2 heparin binding domain-containing peptide sequence
KHRIGINNPRK

SEQ ID NO: 3777 - protein, 11 aa, Artificial
  IGFBP-2 heparin binding domain-containing peptide sequence
RHRIGINNPRK

SEQ ID NO: 3778 - protein, 11 aa, Artificial
  IGFBP-2 heparin binding domain-containing peptide sequence
HHRIGINNPRK

SEQ ID NO: 3779 - protein, 11 aa, Artificial
  IGFBP-2 heparin binding domain-containing peptide sequence
KKRIGINNPRK

SEQ ID NO: 3780 - protein, 11 aa, Artificial
  IGFBP-2 heparin binding domain-containing peptide sequence
RKRIGINNPRK

SEQ ID NO: 3781 - protein, 11 aa, Artificial
  IGFBP-2 heparin binding domain-containing peptide sequence
HKRIGINNPRK

SEQ ID NO: 3782 - protein, 11 aa, Artificial
  IGFBP-2 heparin binding domain-containing peptide sequence
KRRIGINNPRK

SEQ ID NO: 3783 - protein, 11 aa, Artificial
  IGFBP-2 heparin binding domain-containing peptide sequence
RRRIGINNPRK

SEQ ID NO: 3784 - protein, 11 aa, Artificial
  IGFBP-2 heparin binding domain-containing peptide sequence
HRRIGINNPRK

SEQ ID NO: 3785 - protein, 11 aa, Artificial
  IGFBP-2 heparin binding domain-containing peptide sequence
KHHVGINNPRK

SEQ ID NO: 3786 - protein, 11 aa, Artificial
  IGFBP-2 heparin binding domain-containing peptide sequence
RHHVGINNPRK

SEQ ID NO: 3787 - protein, 11 aa, Artificial
  IGFBP-2 heparin binding domain-containing peptide sequence
HHHVGINNPRK

SEQ ID NO: 3788 - protein, 11 aa, Artificial
  IGFBP-2 heparin binding domain-containing peptide sequence
KKHVGINNPRK

SEQ ID NO: 3789 - protein, 11 aa, Artificial
  IGFBP-2 heparin binding domain-containing peptide sequence
RKHVGINNPRK

SEQ ID NO: 3790 - protein, 11 aa, Artificial
  IGFBP-2 heparin binding domain-containing peptide sequence
HKHVGINNPRK

SEQ ID NO: 3791 - protein, 11 aa, Artificial
  IGFBP-2 heparin binding domain-containing peptide sequence
KRHVGINNPRK

SEQ ID NO: 3792 - protein, 11 aa, Artificial
  IGFBP-2 heparin binding domain-containing peptide sequence
RRHVGINNPRK

SEQ ID NO: 3793 - protein, 11 aa, Artificial
  IGFBP-2 heparin binding domain-containing peptide sequence
HRHVGINNPRK

SEQ ID NO: 3794 - protein, 11 aa, Artificial
  IGFBP-2 heparin binding domain-containing peptide sequence
KHKVGINNPRK

SEQ ID NO: 3795 - protein, 11 aa, Artificial
  IGFBP-2 heparin binding domain-containing peptide sequence
RHKVGINNPRK

SEQ ID NO: 3796 - protein, 11 aa, Artificial
  IGFBP-2 heparin binding domain-containing peptide sequence
HHKVGINNPRK

SEQ ID NO: 3797 - protein, 11 aa, Artificial
  IGFBP-2 heparin binding domain-containing peptide sequence
KKKVGINNPRK

SEQ ID NO: 3798 - protein, 11 aa, Artificial
  IGFBP-2 heparin binding domain-containing peptide sequence
RKKVGINNPRK

SEQ ID NO: 3799 - protein, 11 aa, Artificial
  IGFBP-2 heparin binding domain-containing peptide sequence
HKKVGINNPRK

SEQ ID NO: 3800 - protein, 11 aa, Artificial
  IGFBP-2 heparin binding domain-containing peptide sequence
KRKVGINNPRK

SEQ ID NO: 3801 - protein, 11 aa, Artificial
  IGFBP-2 heparin binding domain-containing peptide sequence
RRKVGINNPRK

SEQ ID NO: 3802 - protein, 11 aa, Artificial
  IGFBP-2 heparin binding domain-containing peptide sequence
HRKVGINNPRK

SEQ ID NO: 3803 - protein, 11 aa, Artificial
  IGFBP-2 heparin binding domain-containing peptide sequence
KHRVGINNPRK

SEQ ID NO: 3804 - protein, 11 aa, Artificial
  IGFBP-2 heparin binding domain-containing peptide sequence
RHRVGINNPRK

SEQ ID NO: 3805 - protein, 11 aa, Artificial
  IGFBP-2 heparin binding domain-containing peptide sequence
HHRVGINNPRK

SEQ ID NO: 3806 - protein, 11 aa, Artificial
  IGFBP-2 heparin binding domain-containing peptide sequence
KKRVGINNPRK

SEQ ID NO: 3807 - protein, 11 aa, Artificial
  IGFBP-2 heparin binding domain-containing peptide sequence
RKRVGINNPRK

SEQ ID NO: 3808 - protein, 11 aa, Artificial
  IGFBP-2 heparin binding domain-containing peptide sequence
HKRVGINNPRK

SEQ ID NO: 3809 - protein, 11 aa, Artificial
  IGFBP-2 heparin binding domain-containing peptide sequence
KRRVGINNPRK

SEQ ID NO: 3810 - protein, 11 aa, Artificial
  IGFBP-2 heparin binding domain-containing peptide sequence
RRRVGINNPRK

SEQ ID NO: 3811 - protein, 11 aa, Artificial
  IGFBP-2 heparin binding domain-containing peptide sequence
HRRVGINNPRK

SEQ ID NO: 3812 - protein, 11 aa, Artificial
  IGFBP-2 heparin binding domain-containing peptide sequence
KHHLGVNNPRK

SEQ ID NO: 3813 - protein, 11 aa, Artificial
  IGFBP-2 heparin binding domain-containing peptide sequence
RHHLGVNNPRK

SEQ ID NO: 3814 - protein, 11 aa, Artificial
  IGFBP-2 heparin binding domain-containing peptide sequence
HHHLGVNNPRK

SEQ ID NO: 3815 - protein, 11 aa, Artificial
  IGFBP-2 heparin binding domain-containing peptide sequence
KKHLGVNNPRK

SEQ ID NO: 3816 - protein, 11 aa, Artificial
  IGFBP-2 heparin binding domain-containing peptide sequence
RKHLGVNNPRK

SEQ ID NO: 3817 - protein, 11 aa, Artificial
  IGFBP-2 heparin binding domain-containing peptide sequence
HKHLGVNNPRK

SEQ ID NO: 3818 - protein, 11 aa, Artificial
  IGFBP-2 heparin binding domain-containing peptide sequence
KRHLGVNNPRK

SEQ ID NO: 3819 - protein, 11 aa, Artificial
  IGFBP-2 heparin binding domain-containing peptide sequence
RRHLGVNNPRK

SEQ ID NO: 3820 - protein, 11 aa, Artificial
  IGFBP-2 heparin binding domain-containing peptide sequence
HRHLGVNNPRK

SEQ ID NO: 3821 - protein, 11 aa, Artificial
  IGFBP-2 heparin binding domain-containing peptide sequence
KHKLGVNNPRK

SEQ ID NO: 3822 - protein, 11 aa, Artificial
  IGFBP-2 heparin binding domain-containing peptide sequence
RHKLGVNNPRK

SEQ ID NO: 3823 - protein, 11 aa, Artificial
  IGFBP-2 heparin binding domain-containing peptide sequence
HHKLGVNNPRK

SEQ ID NO: 3824 - protein, 11 aa, Artificial
  IGFBP-2 heparin binding domain-containing peptide sequence
KKKLGVNNPRK

SEQ ID NO: 3825 - protein, 11 aa, Artificial
  IGFBP-2 heparin binding domain-containing peptide sequence
RKKLGVNNPRK

SEQ ID NO: 3826 - protein, 11 aa, Artificial
  IGFBP-2 heparin binding domain-containing peptide sequence
HKKLGVNNPRK

SEQ ID NO: 3827 - protein, 11 aa, Artificial
  IGFBP-2 heparin binding domain-containing peptide sequence
KRKLGVNNPRK

SEQ ID NO: 3828 - protein, 11 aa, Artificial
  IGFBP-2 heparin binding domain-containing peptide sequence
RRKLGVNNPRK

SEQ ID NO: 3829 - protein, 11 aa, Artificial
  IGFBP-2 heparin binding domain-containing peptide sequence
HRKLGVNNPRK

SEQ ID NO: 3830 - protein, 11 aa, Artificial
  IGFBP-2 heparin binding domain-containing peptide sequence
KHRLGVNNPRK

SEQ ID NO: 3831 - protein, 11 aa, Artificial
  IGFBP-2 heparin binding domain-containing peptide sequence
RHRLGVNNPRK

SEQ ID NO: 3832 - protein, 11 aa, Artificial
  IGFBP-2 heparin binding domain-containing peptide sequence
HHRLGVNNPRK

SEQ ID NO: 3833 - protein, 11 aa, Artificial
  IGFBP-2 heparin binding domain-containing peptide sequence
KKRLGVNNPRK

SEQ ID NO: 3834 - protein, 11 aa, Artificial
  IGFBP-2 heparin binding domain-containing peptide sequence
RKRLGVNNPRK

SEQ ID NO: 3835 - protein, 11 aa, Artificial
  IGFBP-2 heparin binding domain-containing peptide sequence
HKRLGVNNPRK

SEQ ID NO: 3836 - protein, 11 aa, Artificial
  IGFBP-2 heparin binding domain-containing peptide sequence
KRRLGVNNPRK

SEQ ID NO: 3837 - protein, 11 aa, Artificial
  IGFBP-2 heparin binding domain-containing peptide sequence
RRRLGVNNPRK

SEQ ID NO: 3838 - protein, 11 aa, Artificial
  IGFBP-2 heparin binding domain-containing peptide sequence
HRRLGVNNPRK

SEQ ID NO: 3839 - protein, 11 aa, Artificial
  IGFBP-2 heparin binding domain-containing peptide sequence
KHHIGVNNPRK

SEQ ID NO: 3840 - protein, 11 aa, Artificial
  IGFBP-2 heparin binding domain-containing peptide sequence
RHHIGVNNPRK

SEQ ID NO: 3841 - protein, 11 aa, Artificial
  IGFBP-2 heparin binding domain-containing peptide sequence
HHHIGVNNPRK

SEQ ID NO: 3842 - protein, 11 aa, Artificial
  IGFBP-2 heparin binding domain-containing peptide sequence
KKHIGVNNPRK

SEQ ID NO: 3843 - protein, 11 aa, Artificial
  IGFBP-2 heparin binding domain-containing peptide sequence
RKHIGVNNPRK

SEQ ID NO: 3844 - protein, 11 aa, Artificial
  IGFBP-2 heparin binding domain-containing peptide sequence
HKHIGVNNPRK

SEQ ID NO: 3845 - protein, 11 aa, Artificial
  IGFBP-2 heparin binding domain-containing peptide sequence
KRHIGVNNPRK

SEQ ID NO: 3846 - protein, 11 aa, Artificial
  IGFBP-2 heparin binding domain-containing peptide sequence
RRHIGVNNPRK

SEQ ID NO: 3847 - protein, 11 aa, Artificial
  IGFBP-2 heparin binding domain-containing peptide sequence
HRHIGVNNPRK

SEQ ID NO: 3848 - protein, 11 aa, Artificial
  IGFBP-2 heparin binding domain-containing peptide sequence
KHKIGVNNPRK

SEQ ID NO: 3849 - protein, 11 aa, Artificial
  IGFBP-2 heparin binding domain-containing peptide sequence
RHKIGVNNPRK

SEQ ID NO: 3850 - protein, 11 aa, Artificial
  IGFBP-2 heparin binding domain-containing peptide sequence
HHKIGVNNPRK

SEQ ID NO: 3851 - protein, 11 aa, Artificial
  IGFBP-2 heparin binding domain-containing peptide sequence
KKKIGVNNPRK

SEQ ID NO: 3852 - protein, 11 aa, Artificial
  IGFBP-2 heparin binding domain-containing peptide sequence
RKKIGVNNPRK

SEQ ID NO: 3853 - protein, 11 aa, Artificial
  IGFBP-2 heparin binding domain-containing peptide sequence
HKKIGVNNPRK

SEQ ID NO: 3854 - protein, 11 aa, Artificial
  IGFBP-2 heparin binding domain-containing peptide sequence
KRKIGVNNPRK

SEQ ID NO: 3855 - protein, 11 aa, Artificial
  IGFBP-2 heparin binding domain-containing peptide sequence
RRKIGVNNPRK

SEQ ID NO: 3856 - protein, 11 aa, Artificial
  IGFBP-2 heparin binding domain-containing peptide sequence
HRKIGVNNPRK

SEQ ID NO: 3857 - protein, 11 aa, Artificial
  IGFBP-2 heparin binding domain-containing peptide sequence
KHRIGVNNPRK

SEQ ID NO: 3858 - protein, 11 aa, Artificial
  IGFBP-2 heparin binding domain-containing peptide sequence
RHRIGVNNPRK

SEQ ID NO: 3859 - protein, 11 aa, Artificial
  IGFBP-2 heparin binding domain-containing peptide sequence
HHRIGVNNPRK

SEQ ID NO: 3860 - protein, 11 aa, Artificial
  IGFBP-2 heparin binding domain-containing peptide sequence
KKRIGVNNPRK

SEQ ID NO: 3861 - protein, 11 aa, Artificial
  IGFBP-2 heparin binding domain-containing peptide sequence
RKRIGVNNPRK

SEQ ID NO: 3862 - protein, 11 aa, Artificial
  IGFBP-2 heparin binding domain-containing peptide sequence
HKRIGVNNPRK

SEQ ID NO: 3863 - protein, 11 aa, Artificial
  IGFBP-2 heparin binding domain-containing peptide sequence
KRRIGVNNPRK

SEQ ID NO: 3864 - protein, 11 aa, Artificial
  IGFBP-2 heparin binding domain-containing peptide sequence
RRRIGVNNPRK

SEQ ID NO: 3865 - protein, 11 aa, Artificial
  IGFBP-2 heparin binding domain-containing peptide sequence
HRRIGVNNPRK

SEQ ID NO: 3866 - protein, 11 aa, Artificial
  IGFBP-2 heparin binding domain-containing peptide sequence
KHHVGVNNPRK

SEQ ID NO: 3867 - protein, 11 aa, Artificial
  IGFBP-2 heparin binding domain-containing peptide sequence
RHHVGVNNPRK

SEQ ID NO: 3868 - protein, 11 aa, Artificial
  IGFBP-2 heparin binding domain-containing peptide sequence
HHHVGVNNPRK

SEQ ID NO: 3869 - protein, 11 aa, Artificial
  IGFBP-2 heparin binding domain-containing peptide sequence
KKHVGVNNPRK

SEQ ID NO: 3870 - protein, 11 aa, Artificial
  IGFBP-2 heparin binding domain-containing peptide sequence
RKHVGVNNPRK

SEQ ID NO: 3871 - protein, 11 aa, Artificial
  IGFBP-2 heparin binding domain-containing peptide sequence
HKHVGVNNPRK

SEQ ID NO: 3872 - protein, 11 aa, Artificial
  IGFBP-2 heparin binding domain-containing peptide sequence
KRHVGVNNPRK

SEQ ID NO: 3873 - protein, 11 aa, Artificial
  IGFBP-2 heparin binding domain-containing peptide sequence
RRHVGVNNPRK

SEQ ID NO: 3874 - protein, 11 aa, Artificial
  IGFBP-2 heparin binding domain-containing peptide sequence
HRHVGVNNPRK

SEQ ID NO: 3875 - protein, 11 aa, Artificial
  IGFBP-2 heparin binding domain-containing peptide sequence
KHKVGVNNPRK

SEQ ID NO: 3876 - protein, 11 aa, Artificial
  IGFBP-2 heparin binding domain-containing peptide sequence
RHKVGVNNPRK

SEQ ID NO: 3877 - protein, 11 aa, Artificial
  IGFBP-2 heparin binding domain-containing peptide sequence
HHKVGVNNPRK

SEQ ID NO: 3878 - protein, 11 aa, Artificial
  IGFBP-2 heparin binding domain-containing peptide sequence
KKKVGVNNPRK

SEQ ID NO: 3879 - protein, 11 aa, Artificial
  IGFBP-2 heparin binding domain-containing peptide sequence
RKKVGVNNPRK

SEQ ID NO: 3880 - protein, 11 aa, Artificial
  IGFBP-2 heparin binding domain-containing peptide sequence
HKKVGVNNPRK

SEQ ID NO: 3881 - protein, 11 aa, Artificial
  IGFBP-2 heparin binding domain-containing peptide sequence
KRKVGVNNPRK

SEQ ID NO: 3882 - protein, 11 aa, Artificial
  IGFBP-2 heparin binding domain-containing peptide sequence
RRKVGVNNPRK

SEQ ID NO: 3883 - protein, 11 aa, Artificial
  IGFBP-2 heparin binding domain-containing peptide sequence
HRKVGVNNPRK

SEQ ID NO: 3884 - protein, 11 aa, Artificial
  IGFBP-2 heparin binding domain-containing peptide sequence
KHRVGVNNPRK

SEQ ID NO: 3885 - protein, 11 aa, Artificial
  IGFBP-2 heparin binding domain-containing peptide sequence
RHRVGVNNPRK

SEQ ID NO: 3886 - protein, 11 aa, Artificial
  IGFBP-2 heparin binding domain-containing peptide sequence
HHRVGVNNPRK

SEQ ID NO: 3887 - protein, 11 aa, Artificial
  IGFBP-2 heparin binding domain-containing peptide sequence
KKRVGVNNPRK

SEQ ID NO: 3888 - protein, 11 aa, Artificial
  IGFBP-2 heparin binding domain-containing peptide sequence
RKRVGVNNPRK

SEQ ID NO: 3889 - protein, 11 aa, Artificial
  IGFBP-2 heparin binding domain-containing peptide sequence
HKRVGVNNPRK

SEQ ID NO: 3890 - protein, 11 aa, Artificial
  IGFBP-2 heparin binding domain-containing peptide sequence
KRRVGVNNPRK

SEQ ID NO: 3891 - protein, 11 aa, Artificial
  IGFBP-2 heparin binding domain-containing peptide sequence
RRRVGVNNPRK

SEQ ID NO: 3892 - protein, 11 aa, Artificial
  IGFBP-2 heparin binding domain-containing peptide sequence
HRRVGVNNPRK

SEQ ID NO: 3893 - protein, 11 aa, Artificial
  IGFBP-2 heparin binding domain-containing peptide sequence
KHHLGLEEPHK

SEQ ID NO: 3894 - protein, 11 aa, Artificial
  IGFBP-2 heparin binding domain-containing peptide sequence
RHHLGLEEPHK

SEQ ID NO: 3895 - protein, 11 aa, Artificial
  IGFBP-2 heparin binding domain-containing peptide sequence
HHHLGLEEPHK

SEQ ID NO: 3896 - protein, 11 aa, Artificial
  IGFBP-2 heparin binding domain-containing peptide sequence
KKHLGLEEPHK

SEQ ID NO: 3897 - protein, 11 aa, Artificial
  IGFBP-2 heparin binding domain-containing peptide sequence
RKHLGLEEPHK

SEQ ID NO: 3898 - protein, 11 aa, Artificial
  IGFBP-2 heparin binding domain-containing peptide sequence
HKHLGLEEPHK

SEQ ID NO: 3899 - protein, 11 aa, Artificial
  IGFBP-2 heparin binding domain-containing peptide sequence
KRHLGLEEPHK

SEQ ID NO: 3900 - protein, 11 aa, Artificial
  IGFBP-2 heparin binding domain-containing peptide sequence
RRHLGLEEPHK

SEQ ID NO: 3901 - protein, 11 aa, Artificial
  IGFBP-2 heparin binding domain-containing peptide sequence
HRHLGLEEPHK

SEQ ID NO: 3902 - protein, 11 aa, Artificial
  IGFBP-2 heparin binding domain-containing peptide sequence
KHKLGLEEPHK

SEQ ID NO: 3903 - protein, 11 aa, Artificial
  IGFBP-2 heparin binding domain-containing peptide sequence
RHKLGLEEPHK

SEQ ID NO: 3904 - protein, 11 aa, Artificial
  IGFBP-2 heparin binding domain-containing peptide sequence
HHKLGLEEPHK

SEQ ID NO: 3905 - protein, 11 aa, Artificial
  IGFBP-2 heparin binding domain-containing peptide sequence
KKKLGLEEPHK

SEQ ID NO: 3906 - protein, 11 aa, Artificial
  IGFBP-2 heparin binding domain-containing peptide sequence
RKKLGLEEPHK

SEQ ID NO: 3907 - protein, 11 aa, Artificial
  IGFBP-2 heparin binding domain-containing peptide sequence
HKKLGLEEPHK

SEQ ID NO: 3908 - protein, 11 aa, Artificial
  IGFBP-2 heparin binding domain-containing peptide sequence
KRKLGLEEPHK

SEQ ID NO: 3909 - protein, 11 aa, Artificial
  IGFBP-2 heparin binding domain-containing peptide sequence
RRKLGLEEPHK

SEQ ID NO: 3910 - protein, 11 aa, Artificial
  IGFBP-2 heparin binding domain-containing peptide sequence
HRKLGLEEPHK

SEQ ID NO: 3911 - protein, 11 aa, Artificial
  IGFBP-2 heparin binding domain-containing peptide sequence
KHRLGLEEPHK

SEQ ID NO: 3912 - protein, 11 aa, Artificial
  IGFBP-2 heparin binding domain-containing peptide sequence
RHRLGLEEPHK

SEQ ID NO: 3913 - protein, 11 aa, Artificial
  IGFBP-2 heparin binding domain-containing peptide sequence
HHRLGLEEPHK

SEQ ID NO: 3914 - protein, 11 aa, Artificial
  IGFBP-2 heparin binding domain-containing peptide sequence
KKRLGLEEPHK

SEQ ID NO: 3915 - protein, 11 aa, Artificial
  IGFBP-2 heparin binding domain-containing peptide sequence
RKRLGLEEPHK

SEQ ID NO: 3916 - protein, 11 aa, Artificial
  IGFBP-2 heparin binding domain-containing peptide sequence
HKRLGLEEPHK

SEQ ID NO: 3917 - protein, 11 aa, Artificial
  IGFBP-2 heparin binding domain-containing peptide sequence
KRRLGLEEPHK

SEQ ID NO: 3918 - protein, 11 aa, Artificial
  IGFBP-2 heparin binding domain-containing peptide sequence
RRRLGLEEPHK

SEQ ID NO: 3919 - protein, 11 aa, Artificial
  IGFBP-2 heparin binding domain-containing peptide sequence
HRRLGLEEPHK

SEQ ID NO: 3920 - protein, 11 aa, Artificial
  IGFBP-2 heparin binding domain-containing peptide sequence
KHHIGLEEPHK

SEQ ID NO: 3921 - protein, 11 aa, Artificial
  IGFBP-2 heparin binding domain-containing peptide sequence
RHHIGLEEPHK

SEQ ID NO: 3922 - protein, 11 aa, Artificial
  IGFBP-2 heparin binding domain-containing peptide sequence
HHHIGLEEPHK

SEQ ID NO: 3923 - protein, 11 aa, Artificial
  IGFBP-2 heparin binding domain-containing peptide sequence
KKHIGLEEPHK

SEQ ID NO: 3924 - protein, 11 aa, Artificial
  IGFBP-2 heparin binding domain-containing peptide sequence
RKHIGLEEPHK

SEQ ID NO: 3925 - protein, 11 aa, Artificial
  IGFBP-2 heparin binding domain-containing peptide sequence
HKHIGLEEPHK

SEQ ID NO: 3926 - protein, 11 aa, Artificial
  IGFBP-2 heparin binding domain-containing peptide sequence
KRHIGLEEPHK

SEQ ID NO: 3927 - protein, 11 aa, Artificial
  IGFBP-2 heparin binding domain-containing peptide sequence
RRHIGLEEPHK

SEQ ID NO: 3928 - protein, 11 aa, Artificial
  IGFBP-2 heparin binding domain-containing peptide sequence
HRHIGLEEPHK

SEQ ID NO: 3929 - protein, 11 aa, Artificial
  IGFBP-2 heparin binding domain-containing peptide sequence
KHKIGLEEPHK

SEQ ID NO: 3930 - protein, 11 aa, Artificial
  IGFBP-2 heparin binding domain-containing peptide sequence
RHKIGLEEPHK

SEQ ID NO: 3931 - protein, 11 aa, Artificial
  IGFBP-2 heparin binding domain-containing peptide sequence
HHKIGLEEPHK

SEQ ID NO: 3932 - protein, 11 aa, Artificial
  IGFBP-2 heparin binding domain-containing peptide sequence
KKKIGLEEPHK

SEQ ID NO: 3933 - protein, 11 aa, Artificial
  IGFBP-2 heparin binding domain-containing peptide sequence
RKKIGLEEPHK

SEQ ID NO: 3934 - protein, 11 aa, Artificial
  IGFBP-2 heparin binding domain-containing peptide sequence
HKKIGLEEPHK

SEQ ID NO: 3935 - protein, 11 aa, Artificial
  IGFBP-2 heparin binding domain-containing peptide sequence
KRKIGLEEPHK

SEQ ID NO: 3936 - protein, 11 aa, Artificial
  IGFBP-2 heparin binding domain-containing peptide sequence
RRKIGLEEPHK

SEQ ID NO: 3937 - protein, 11 aa, Artificial
  IGFBP-2 heparin binding domain-containing peptide sequence
HRKIGLEEPHK

SEQ ID NO: 3938 - protein, 11 aa, Artificial
  IGFBP-2 heparin binding domain-containing peptide sequence
KHRIGLEEPHK

SEQ ID NO: 3939 - protein, 11 aa, Artificial
  IGFBP-2 heparin binding domain-containing peptide sequence
RHRIGLEEPHK

SEQ ID NO: 3940 - protein, 11 aa, Artificial
  IGFBP-2 heparin binding domain-containing peptide sequence
HHRIGLEEPHK

SEQ ID NO: 3941 - protein, 11 aa, Artificial
  IGFBP-2 heparin binding domain-containing peptide sequence
KKRIGLEEPHK

SEQ ID NO: 3942 - protein, 11 aa, Artificial
  IGFBP-2 heparin binding domain-containing peptide sequence
RKRIGLEEPHK

SEQ ID NO: 3943 - protein, 11 aa, Artificial
  IGFBP-2 heparin binding domain-containing peptide sequence
HKRIGLEEPHK

SEQ ID NO: 3944 - protein, 11 aa, Artificial
  IGFBP-2 heparin binding domain-containing peptide sequence
KRRIGLEEPHK

SEQ ID NO: 3945 - protein, 11 aa, Artificial
  IGFBP-2 heparin binding domain-containing peptide sequence
RRRIGLEEPHK

SEQ ID NO: 3946 - protein, 11 aa, Artificial
  IGFBP-2 heparin binding domain-containing peptide sequence
HRRIGLEEPHK

SEQ ID NO: 3947 - protein, 11 aa, Artificial
  IGFBP-2 heparin binding domain-containing peptide sequence
KHHVGLEEPHK

SEQ ID NO: 3948 - protein, 11 aa, Artificial
  IGFBP-2 heparin binding domain-containing peptide sequence
RHHVGLEEPHK

SEQ ID NO: 3949 - protein, 11 aa, Artificial
  IGFBP-2 heparin binding domain-containing peptide sequence
HHHVGLEEPHK

SEQ ID NO: 3950 - protein, 11 aa, Artificial
  IGFBP-2 heparin binding domain-containing peptide sequence
KKHVGLEEPHK

SEQ ID NO: 3951 - protein, 11 aa, Artificial
  IGFBP-2 heparin binding domain-containing peptide sequence
RKHVGLEEPHK

SEQ ID NO: 3952 - protein, 11 aa, Artificial
  IGFBP-2 heparin binding domain-containing peptide sequence
HKHVGLEEPHK

SEQ ID NO: 3953 - protein, 11 aa, Artificial
  IGFBP-2 heparin binding domain-containing peptide sequence
KRHVGLEEPHK

SEQ ID NO: 3954 - protein, 11 aa, Artificial
  IGFBP-2 heparin binding domain-containing peptide sequence
RRHVGLEEPHK

SEQ ID NO: 3955 - protein, 11 aa, Artificial
  IGFBP-2 heparin binding domain-containing peptide sequence
HRHVGLEEPHK

SEQ ID NO: 3956 - protein, 11 aa, Artificial
  IGFBP-2 heparin binding domain-containing peptide sequence
KHKVGLEEPHK

SEQ ID NO: 3957 - protein, 11 aa, Artificial
  IGFBP-2 heparin binding domain-containing peptide sequence
RHKVGLEEPHK

SEQ ID NO: 3958 - protein, 11 aa, Artificial
  IGFBP-2 heparin binding domain-containing peptide sequence
HHKVGLEEPHK

SEQ ID NO: 3959 - protein, 11 aa, Artificial
  IGFBP-2 heparin binding domain-containing peptide sequence
KKKVGLEEPHK

SEQ ID NO: 3960 - protein, 11 aa, Artificial
  IGFBP-2 heparin binding domain-containing peptide sequence
RKKVGLEEPHK

SEQ ID NO: 3961 - protein, 11 aa, Artificial
  IGFBP-2 heparin binding domain-containing peptide sequence
HKKVGLEEPHK

SEQ ID NO: 3962 - protein, 11 aa, Artificial
  IGFBP-2 heparin binding domain-containing peptide sequence
KRKVGLEEPHK

SEQ ID NO: 3963 - protein, 11 aa, Artificial
  IGFBP-2 heparin binding domain-containing peptide sequence
RRKVGLEEPHK

SEQ ID NO: 3964 - protein, 11 aa, Artificial
  IGFBP-2 heparin binding domain-containing peptide sequence
HRKVGLEEPHK

SEQ ID NO: 3965 - protein, 11 aa, Artificial
  IGFBP-2 heparin binding domain-containing peptide sequence
KHRVGLEEPHK

SEQ ID NO: 3966 - protein, 11 aa, Artificial
  IGFBP-2 heparin binding domain-containing peptide sequence
RHRVGLEEPHK

SEQ ID NO: 3967 - protein, 11 aa, Artificial
  IGFBP-2 heparin binding domain-containing peptide sequence
HHRVGLEEPHK

SEQ ID NO: 3968 - protein, 11 aa, Artificial
  IGFBP-2 heparin binding domain-containing peptide sequence
KKRVGLEEPHK

SEQ ID NO: 3969 - protein, 11 aa, Artificial
  IGFBP-2 heparin binding domain-containing peptide sequence
RKRVGLEEPHK

SEQ ID NO: 3970 - protein, 11 aa, Artificial
  IGFBP-2 heparin binding domain-containing peptide sequence
HKRVGLEEPHK

SEQ ID NO: 3971 - protein, 11 aa, Artificial
  IGFBP-2 heparin binding domain-containing peptide sequence
KRRVGLEEPHK

SEQ ID NO: 3972 - protein, 11 aa, Artificial
  IGFBP-2 heparin binding domain-containing peptide sequence
RRRVGLEEPHK

SEQ ID NO: 3973 - protein, 11 aa, Artificial
  IGFBP-2 heparin binding domain-containing peptide sequence
HRRVGLEEPHK

SEQ ID NO: 3974 - protein, 11 aa, Artificial
  IGFBP-2 heparin binding domain-containing peptide sequence
KHHLGIEEPHK

SEQ ID NO: 3975 - protein, 11 aa, Artificial
  IGFBP-2 heparin binding domain-containing peptide sequence
RHHLGIEEPHK

SEQ ID NO: 3976 - protein, 11 aa, Artificial
  IGFBP-2 heparin binding domain-containing peptide sequence
HHHLGIEEPHK

SEQ ID NO: 3977 - protein, 11 aa, Artificial
  IGFBP-2 heparin binding domain-containing peptide sequence
KKHLGIEEPHK

SEQ ID NO: 3978 - protein, 11 aa, Artificial
  IGFBP-2 heparin binding domain-containing peptide sequence
RKHLGIEEPHK

SEQ ID NO: 3979 - protein, 11 aa, Artificial
  IGFBP-2 heparin binding domain-containing peptide sequence
HKHLGIEEPHK

SEQ ID NO: 3980 - protein, 11 aa, Artificial
  IGFBP-2 heparin binding domain-containing peptide sequence
KRHLGIEEPHK

SEQ ID NO: 3981 - protein, 11 aa, Artificial
  IGFBP-2 heparin binding domain-containing peptide sequence
RRHLGIEEPHK

SEQ ID NO: 3982 - protein, 11 aa, Artificial
  IGFBP-2 heparin binding domain-containing peptide sequence
HRHLGIEEPHK

SEQ ID NO: 3983 - protein, 11 aa, Artificial
  IGFBP-2 heparin binding domain-containing peptide sequence
KHKLGIEEPHK

SEQ ID NO: 3984 - protein, 11 aa, Artificial
  IGFBP-2 heparin binding domain-containing peptide sequence
RHKLGIEEPHK

SEQ ID NO: 3985 - protein, 11 aa, Artificial
  IGFBP-2 heparin binding domain-containing peptide sequence
HHKLGIEEPHK

SEQ ID NO: 3986 - protein, 11 aa, Artificial
  IGFBP-2 heparin binding domain-containing peptide sequence
KKKLGIEEPHK

SEQ ID NO: 3987 - protein, 11 aa, Artificial
  IGFBP-2 heparin binding domain-containing peptide sequence
RKKLGIEEPHK

SEQ ID NO: 3988 - protein, 11 aa, Artificial
  IGFBP-2 heparin binding domain-containing peptide sequence
HKKLGIEEPHK

SEQ ID NO: 3989 - protein, 11 aa, Artificial
  IGFBP-2 heparin binding domain-containing peptide sequence
KRKLGIEEPHK

SEQ ID NO: 3990 - protein, 11 aa, Artificial
  IGFBP-2 heparin binding domain-containing peptide sequence
RRKLGIEEPHK

SEQ ID NO: 3991 - protein, 11 aa, Artificial
  IGFBP-2 heparin binding domain-containing peptide sequence
HRKLGIEEPHK

SEQ ID NO: 3992 - protein, 11 aa, Artificial
  IGFBP-2 heparin binding domain-containing peptide sequence
KHRLGIEEPHK

SEQ ID NO: 3993 - protein, 11 aa, Artificial
  IGFBP-2 heparin binding domain-containing peptide sequence
RHRLGIEEPHK

SEQ ID NO: 3994 - protein, 11 aa, Artificial
  IGFBP-2 heparin binding domain-containing peptide sequence
HHRLGIEEPHK

SEQ ID NO: 3995 - protein, 11 aa, Artificial
  IGFBP-2 heparin binding domain-containing peptide sequence
KKRLGIEEPHK

SEQ ID NO: 3996 - protein, 11 aa, Artificial
  IGFBP-2 heparin binding domain-containing peptide sequence
RKRLGIEEPHK

SEQ ID NO: 3997 - protein, 11 aa, Artificial
  IGFBP-2 heparin binding domain-containing peptide sequence
HKRLGIEEPHK

SEQ ID NO: 3998 - protein, 11 aa, Artificial
  IGFBP-2 heparin binding domain-containing peptide sequence
KRRLGIEEPHK

SEQ ID NO: 3999 - protein, 11 aa, Artificial
  IGFBP-2 heparin binding domain-containing peptide sequence
RRRLGIEEPHK

SEQ ID NO: 4000 - protein, 11 aa, Artificial
  IGFBP-2 heparin binding domain-containing peptide sequence
HRRLGIEEPHK

SEQ ID NO: 4001 - protein, 11 aa, Artificial
  IGFBP-2 heparin binding domain-containing peptide sequence
KHHIGIEEPHK

SEQ ID NO: 4002 - protein, 11 aa, Artificial
  IGFBP-2 heparin binding domain-containing peptide sequence
RHHIGIEEPHK

SEQ ID NO: 4003 - protein, 11 aa, Artificial
  IGFBP-2 heparin binding domain-containing peptide sequence
HHHIGIEEPHK

SEQ ID NO: 4004 - protein, 11 aa, Artificial
  IGFBP-2 heparin binding domain-containing peptide sequence
KKHIGIEEPHK

SEQ ID NO: 4005 - protein, 11 aa, Artificial
  IGFBP-2 heparin binding domain-containing peptide sequence
RKHIGIEEPHK

SEQ ID NO: 4006 - protein, 11 aa, Artificial
  IGFBP-2 heparin binding domain-containing peptide sequence
HKHIGIEEPHK

SEQ ID NO: 4007 - protein, 11 aa, Artificial
  IGFBP-2 heparin binding domain-containing peptide sequence
KRHIGIEEPHK

SEQ ID NO: 4008 - protein, 11 aa, Artificial
  IGFBP-2 heparin binding domain-containing peptide sequence
RRHIGIEEPHK

SEQ ID NO: 4009 - protein, 11 aa, Artificial
  IGFBP-2 heparin binding domain-containing peptide sequence
HRHIGIEEPHK

SEQ ID NO: 4010 - protein, 11 aa, Artificial
  IGFBP-2 heparin binding domain-containing peptide sequence
KHKIGIEEPHK

SEQ ID NO: 4011 - protein, 11 aa, Artificial
  IGFBP-2 heparin binding domain-containing peptide sequence
RHKIGIEEPHK

SEQ ID NO: 4012 - protein, 11 aa, Artificial
  IGFBP-2 heparin binding domain-containing peptide sequence
HHKIGIEEPHK

SEQ ID NO: 4013 - protein, 11 aa, Artificial
  IGFBP-2 heparin binding domain-containing peptide sequence
KKKIGIEEPHK

SEQ ID NO: 4014 - protein, 11 aa, Artificial
  IGFBP-2 heparin binding domain-containing peptide sequence
RKKIGIEEPHK

SEQ ID NO: 4015 - protein, 11 aa, Artificial
  IGFBP-2 heparin binding domain-containing peptide sequence
HKKIGIEEPHK

SEQ ID NO: 4016 - protein, 11 aa, Artificial
  IGFBP-2 heparin binding domain-containing peptide sequence
KRKIGIEEPHK

SEQ ID NO: 4017 - protein, 11 aa, Artificial
  IGFBP-2 heparin binding domain-containing peptide sequence
RRKIGIEEPHK

SEQ ID NO: 4018 - protein, 11 aa, Artificial
  IGFBP-2 heparin binding domain-containing peptide sequence
HRKIGIEEPHK

SEQ ID NO: 4019 - protein, 11 aa, Artificial
  IGFBP-2 heparin binding domain-containing peptide sequence
KHRIGIEEPHK

SEQ ID NO: 4020 - protein, 11 aa, Artificial
  IGFBP-2 heparin binding domain-containing peptide sequence
RHRIGIEEPHK

SEQ ID NO: 4021 - protein, 11 aa, Artificial
  IGFBP-2 heparin binding domain-containing peptide sequence
HHRIGIEEPHK

SEQ ID NO: 4022 - protein, 11 aa, Artificial
  IGFBP-2 heparin binding domain-containing peptide sequence
KKRIGIEEPHK

SEQ ID NO: 4023 - protein, 11 aa, Artificial
  IGFBP-2 heparin binding domain-containing peptide sequence
RKRIGIEEPHK

SEQ ID NO: 4024 - protein, 11 aa, Artificial
  IGFBP-2 heparin binding domain-containing peptide sequence
HKRIGIEEPHK

SEQ ID NO: 4025 - protein, 11 aa, Artificial
  IGFBP-2 heparin binding domain-containing peptide sequence
KRRIGIEEPHK

SEQ ID NO: 4026 - protein, 11 aa, Artificial
  IGFBP-2 heparin binding domain-containing peptide sequence
RRRIGIEEPHK

SEQ ID NO: 4027 - protein, 11 aa, Artificial
  IGFBP-2 heparin binding domain-containing peptide sequence
HRRIGIEEPHK

SEQ ID NO: 4028 - protein, 11 aa, Artificial
  IGFBP-2 heparin binding domain-containing peptide sequence
KHHVGIEEPHK

SEQ ID NO: 4029 - protein, 11 aa, Artificial
  IGFBP-2 heparin binding domain-containing peptide sequence
RHHVGIEEPHK

SEQ ID NO: 4030 - protein, 11 aa, Artificial
  IGFBP-2 heparin binding domain-containing peptide sequence
HHHVGIEEPHK

SEQ ID NO: 4031 - protein, 11 aa, Artificial
  IGFBP-2 heparin binding domain-containing peptide sequence
KKHVGIEEPHK

SEQ ID NO: 4032 - protein, 11 aa, Artificial
  IGFBP-2 heparin binding domain-containing peptide sequence
RKHVGIEEPHK

SEQ ID NO: 4033 - protein, 11 aa, Artificial
  IGFBP-2 heparin binding domain-containing peptide sequence
HKHVGIEEPHK

SEQ ID NO: 4034 - protein, 11 aa, Artificial
  IGFBP-2 heparin binding domain-containing peptide sequence
KRHVGIEEPHK

SEQ ID NO: 4035 - protein, 11 aa, Artificial
  IGFBP-2 heparin binding domain-containing peptide sequence
RRHVGIEEPHK

SEQ ID NO: 4036 - protein, 11 aa, Artificial
  IGFBP-2 heparin binding domain-containing peptide sequence
HRHVGIEEPHK

SEQ ID NO: 4037 - protein, 11 aa, Artificial
  IGFBP-2 heparin binding domain-containing peptide sequence
KHKVGIEEPHK

SEQ ID NO: 4038 - protein, 11 aa, Artificial
  IGFBP-2 heparin binding domain-containing peptide sequence
RHKVGIEEPHK

SEQ ID NO: 4039 - protein, 11 aa, Artificial
  IGFBP-2 heparin binding domain-containing peptide sequence
HHKVGIEEPHK

SEQ ID NO: 4040 - protein, 11 aa, Artificial
  IGFBP-2 heparin binding domain-containing peptide sequence
KKKVGIEEPHK

SEQ ID NO: 4041 - protein, 11 aa, Artificial
  IGFBP-2 heparin binding domain-containing peptide sequence
RKKVGIEEPHK

SEQ ID NO: 4042 - protein, 11 aa, Artificial
  IGFBP-2 heparin binding domain-containing peptide sequence
HKKVGIEEPHK

SEQ ID NO: 4043 - protein, 11 aa, Artificial
  IGFBP-2 heparin binding domain-containing peptide sequence
KRKVGIEEPHK

SEQ ID NO: 4044 - protein, 11 aa, Artificial
  IGFBP-2 heparin binding domain-containing peptide sequence
RRKVGIEEPHK

SEQ ID NO: 4045 - protein, 11 aa, Artificial
  IGFBP-2 heparin binding domain-containing peptide sequence
HRKVGIEEPHK

SEQ ID NO: 4046 - protein, 11 aa, Artificial
  IGFBP-2 heparin binding domain-containing peptide sequence
KHRVGIEEPHK

SEQ ID NO: 4047 - protein, 11 aa, Artificial
  IGFBP-2 heparin binding domain-containing peptide sequence
RHRVGIEEPHK

SEQ ID NO: 4048 - protein, 11 aa, Artificial
  IGFBP-2 heparin binding domain-containing peptide sequence
HHRVGIEEPHK

SEQ ID NO: 4049 - protein, 11 aa, Artificial
  IGFBP-2 heparin binding domain-containing peptide sequence
KKRVGIEEPHK

SEQ ID NO: 4050 - protein, 11 aa, Artificial
  IGFBP-2 heparin binding domain-containing peptide sequence
RKRVGIEEPHK

SEQ ID NO: 4051 - protein, 11 aa, Artificial
  IGFBP-2 heparin binding domain-containing peptide sequence
HKRVGIEEPHK

SEQ ID NO: 4052 - protein, 11 aa, Artificial
  IGFBP-2 heparin binding domain-containing peptide sequence
KRRVGIEEPHK

SEQ ID NO: 4053 - protein, 11 aa, Artificial
  IGFBP-2 heparin binding domain-containing peptide sequence
RRRVGIEEPHK

SEQ ID NO: 4054 - protein, 11 aa, Artificial
  IGFBP-2 heparin binding domain-containing peptide sequence
HRRVGIEEPHK

SEQ ID NO: 4055 - protein, 11 aa, Artificial
  IGFBP-2 heparin binding domain-containing peptide sequence
KHHLGVEEPHK

SEQ ID NO: 4056 - protein, 11 aa, Artificial
  IGFBP-2 heparin binding domain-containing peptide sequence
RHHLGVEEPHK

SEQ ID NO: 4057 - protein, 11 aa, Artificial
  IGFBP-2 heparin binding domain-containing peptide sequence
HHHLGVEEPHK

SEQ ID NO: 4058 - protein, 11 aa, Artificial
  IGFBP-2 heparin binding domain-containing peptide sequence
KKHLGVEEPHK

SEQ ID NO: 4059 - protein, 11 aa, Artificial
  IGFBP-2 heparin binding domain-containing peptide sequence
RKHLGVEEPHK

SEQ ID NO: 4060 - protein, 11 aa, Artificial
  IGFBP-2 heparin binding domain-containing peptide sequence
HKHLGVEEPHK

SEQ ID NO: 4061 - protein, 11 aa, Artificial
  IGFBP-2 heparin binding domain-containing peptide sequence
KRHLGVEEPHK

SEQ ID NO: 4062 - protein, 11 aa, Artificial
  IGFBP-2 heparin binding domain-containing peptide sequence
RRHLGVEEPHK

SEQ ID NO: 4063 - protein, 11 aa, Artificial
  IGFBP-2 heparin binding domain-containing peptide sequence
HRHLGVEEPHK

SEQ ID NO: 4064 - protein, 11 aa, Artificial
  IGFBP-2 heparin binding domain-containing peptide sequence
KHKLGVEEPHK

SEQ ID NO: 4065 - protein, 11 aa, Artificial
  IGFBP-2 heparin binding domain-containing peptide sequence
RHKLGVEEPHK

SEQ ID NO: 4066 - protein, 11 aa, Artificial
  IGFBP-2 heparin binding domain-containing peptide sequence
HHKLGVEEPHK

SEQ ID NO: 4067 - protein, 11 aa, Artificial
  IGFBP-2 heparin binding domain-containing peptide sequence
KKKLGVEEPHK

SEQ ID NO: 4068 - protein, 11 aa, Artificial
  IGFBP-2 heparin binding domain-containing peptide sequence
RKKLGVEEPHK

SEQ ID NO: 4069 - protein, 11 aa, Artificial
  IGFBP-2 heparin binding domain-containing peptide sequence
HKKLGVEEPHK

SEQ ID NO: 4070 - protein, 11 aa, Artificial
  IGFBP-2 heparin binding domain-containing peptide sequence
KRKLGVEEPHK

SEQ ID NO: 4071 - protein, 11 aa, Artificial
  IGFBP-2 heparin binding domain-containing peptide sequence
RRKLGVEEPHK

SEQ ID NO: 4072 - protein, 11 aa, Artificial
  IGFBP-2 heparin binding domain-containing peptide sequence
HRKLGVEEPHK

SEQ ID NO: 4073 - protein, 11 aa, Artificial
  IGFBP-2 heparin binding domain-containing peptide sequence
KHRLGVEEPHK

SEQ ID NO: 4074 - protein, 11 aa, Artificial
  IGFBP-2 heparin binding domain-containing peptide sequence
RHRLGVEEPHK

SEQ ID NO: 4075 - protein, 11 aa, Artificial
  IGFBP-2 heparin binding domain-containing peptide sequence
HHRLGVEEPHK

SEQ ID NO: 4076 - protein, 11 aa, Artificial
  IGFBP-2 heparin binding domain-containing peptide sequence
KKRLGVEEPHK

SEQ ID NO: 4077 - protein, 11 aa, Artificial
  IGFBP-2 heparin binding domain-containing peptide sequence
RKRLGVEEPHK

SEQ ID NO: 4078 - protein, 11 aa, Artificial
  IGFBP-2 heparin binding domain-containing peptide sequence
HKRLGVEEPHK

SEQ ID NO: 4079 - protein, 11 aa, Artificial
  IGFBP-2 heparin binding domain-containing peptide sequence
KRRLGVEEPHK

SEQ ID NO: 4080 - protein, 11 aa, Artificial
  IGFBP-2 heparin binding domain-containing peptide sequence
RRRLGVEEPHK

SEQ ID NO: 4081 - protein, 11 aa, Artificial
  IGFBP-2 heparin binding domain-containing peptide sequence
HRRLGVEEPHK

SEQ ID NO: 4082 - protein, 11 aa, Artificial
  IGFBP-2 heparin binding domain-containing peptide sequence
KHHIGVEEPHK

SEQ ID NO: 4083 - protein, 11 aa, Artificial
  IGFBP-2 heparin binding domain-containing peptide sequence
RHHIGVEEPHK

SEQ ID NO: 4084 - protein, 11 aa, Artificial
  IGFBP-2 heparin binding domain-containing peptide sequence
HHHIGVEEPHK

SEQ ID NO: 4085 - protein, 11 aa, Artificial
  IGFBP-2 heparin binding domain-containing peptide sequence
KKHIGVEEPHK

SEQ ID NO: 4086 - protein, 11 aa, Artificial
  IGFBP-2 heparin binding domain-containing peptide sequence
RKHIGVEEPHK

SEQ ID NO: 4087 - protein, 11 aa, Artificial
  IGFBP-2 heparin binding domain-containing peptide sequence
HKHIGVEEPHK

SEQ ID NO: 4088 - protein, 11 aa, Artificial
  IGFBP-2 heparin binding domain-containing peptide sequence
KRHIGVEEPHK

SEQ ID NO: 4089 - protein, 11 aa, Artificial
  IGFBP-2 heparin binding domain-containing peptide sequence
RRHIGVEEPHK

SEQ ID NO: 4090 - protein, 11 aa, Artificial
  IGFBP-2 heparin binding domain-containing peptide sequence
HRHIGVEEPHK

SEQ ID NO: 4091 - protein, 11 aa, Artificial
  IGFBP-2 heparin binding domain-containing peptide sequence
KHKIGVEEPHK

SEQ ID NO: 4092 - protein, 11 aa, Artificial
  IGFBP-2 heparin binding domain-containing peptide sequence
RHKIGVEEPHK

SEQ ID NO: 4093 - protein, 11 aa, Artificial
  IGFBP-2 heparin binding domain-containing peptide sequence
HHKIGVEEPHK

SEQ ID NO: 4094 - protein, 11 aa, Artificial
  IGFBP-2 heparin binding domain-containing peptide sequence
KKKIGVEEPHK

SEQ ID NO: 4095 - protein, 11 aa, Artificial
  IGFBP-2 heparin binding domain-containing peptide sequence
RKKIGVEEPHK

SEQ ID NO: 4096 - protein, 11 aa, Artificial
  IGFBP-2 heparin binding domain-containing peptide sequence
HKKIGVEEPHK

SEQ ID NO: 4097 - protein, 11 aa, Artificial
  IGFBP-2 heparin binding domain-containing peptide sequence
KRKIGVEEPHK

SEQ ID NO: 4098 - protein, 11 aa, Artificial
  IGFBP-2 heparin binding domain-containing peptide sequence
RRKIGVEEPHK

SEQ ID NO: 4099 - protein, 11 aa, Artificial
  IGFBP-2 heparin binding domain-containing peptide sequence
HRKIGVEEPHK

SEQ ID NO: 4100 - protein, 11 aa, Artificial
  IGFBP-2 heparin binding domain-containing peptide sequence
KHRIGVEEPHK

SEQ ID NO: 4101 - protein, 11 aa, Artificial
  IGFBP-2 heparin binding domain-containing peptide sequence
RHRIGVEEPHK

SEQ ID NO: 4102 - protein, 11 aa, Artificial
  IGFBP-2 heparin binding domain-containing peptide sequence
HHRIGVEEPHK

SEQ ID NO: 4103 - protein, 11 aa, Artificial
  IGFBP-2 heparin binding domain-containing peptide sequence
KKRIGVEEPHK

SEQ ID NO: 4104 - protein, 11 aa, Artificial
  IGFBP-2 heparin binding domain-containing peptide sequence
RKRIGVEEPHK

SEQ ID NO: 4105 - protein, 11 aa, Artificial
  IGFBP-2 heparin binding domain-containing peptide sequence
HKRIGVEEPHK

SEQ ID NO: 4106 - protein, 11 aa, Artificial
  IGFBP-2 heparin binding domain-containing peptide sequence
KRRIGVEEPHK

SEQ ID NO: 4107 - protein, 11 aa, Artificial
  IGFBP-2 heparin binding domain-containing peptide sequence
RRRIGVEEPHK

SEQ ID NO: 4108 - protein, 11 aa, Artificial
  IGFBP-2 heparin binding domain-containing peptide sequence
HRRIGVEEPHK

SEQ ID NO: 4109 - protein, 11 aa, Artificial
  IGFBP-2 heparin binding domain-containing peptide sequence
KHHVGVEEPHK

SEQ ID NO: 4110 - protein, 11 aa, Artificial
  IGFBP-2 heparin binding domain-containing peptide sequence
RHHVGVEEPHK

SEQ ID NO: 4111 - protein, 11 aa, Artificial
  IGFBP-2 heparin binding domain-containing peptide sequence
HHHVGVEEPHK

SEQ ID NO: 4112 - protein, 11 aa, Artificial
  IGFBP-2 heparin binding domain-containing peptide sequence
KKHVGVEEPHK

SEQ ID NO: 4113 - protein, 11 aa, Artificial
  IGFBP-2 heparin binding domain-containing peptide sequence
RKHVGVEEPHK

SEQ ID NO: 4114 - protein, 11 aa, Artificial
  IGFBP-2 heparin binding domain-containing peptide sequence
HKHVGVEEPHK

SEQ ID NO: 4115 - protein, 11 aa, Artificial
  IGFBP-2 heparin binding domain-containing peptide sequence
KRHVGVEEPHK

SEQ ID NO: 4116 - protein, 11 aa, Artificial
  IGFBP-2 heparin binding domain-containing peptide sequence
RRHVGVEEPHK

SEQ ID NO: 4117 - protein, 11 aa, Artificial
  IGFBP-2 heparin binding domain-containing peptide sequence
HRHVGVEEPHK

SEQ ID NO: 4118 - protein, 11 aa, Artificial
  IGFBP-2 heparin binding domain-containing peptide sequence
KHKVGVEEPHK

SEQ ID NO: 4119 - protein, 11 aa, Artificial
  IGFBP-2 heparin binding domain-containing peptide sequence
RHKVGVEEPHK

SEQ ID NO: 4120 - protein, 11 aa, Artificial
  IGFBP-2 heparin binding domain-containing peptide sequence
HHKVGVEEPHK

SEQ ID NO: 4121 - protein, 11 aa, Artificial
  IGFBP-2 heparin binding domain-containing peptide sequence
KKKVGVEEPHK

SEQ ID NO: 4122 - protein, 11 aa, Artificial
  IGFBP-2 heparin binding domain-containing peptide sequence
RKKVGVEEPHK

SEQ ID NO: 4123 - protein, 11 aa, Artificial
  IGFBP-2 heparin binding domain-containing peptide sequence
HKKVGVEEPHK

SEQ ID NO: 4124 - protein, 11 aa, Artificial
  IGFBP-2 heparin binding domain-containing peptide sequence
KRKVGVEEPHK

SEQ ID NO: 4125 - protein, 11 aa, Artificial
  IGFBP-2 heparin binding domain-containing peptide sequence
RRKVGVEEPHK

SEQ ID NO: 4126 - protein, 11 aa, Artificial
  IGFBP-2 heparin binding domain-containing peptide sequence
HRKVGVEEPHK

SEQ ID NO: 4127 - protein, 11 aa, Artificial
  IGFBP-2 heparin binding domain-containing peptide sequence
KHRVGVEEPHK

SEQ ID NO: 4128 - protein, 11 aa, Artificial
  IGFBP-2 heparin binding domain-containing peptide sequence
RHRVGVEEPHK

SEQ ID NO: 4129 - protein, 11 aa, Artificial
  IGFBP-2 heparin binding domain-containing peptide sequence
HHRVGVEEPHK

SEQ ID NO: 4130 - protein, 11 aa, Artificial
  IGFBP-2 heparin binding domain-containing peptide sequence
KKRVGVEEPHK

SEQ ID NO: 4131 - protein, 11 aa, Artificial
  IGFBP-2 heparin binding domain-containing peptide sequence
RKRVGVEEPHK

SEQ ID NO: 4132 - protein, 11 aa, Artificial
  IGFBP-2 heparin binding domain-containing peptide sequence
HKRVGVEEPHK

SEQ ID NO: 4133 - protein, 11 aa, Artificial
  IGFBP-2 heparin binding domain-containing peptide sequence
KRRVGVEEPHK

SEQ ID NO: 4134 - protein, 11 aa, Artificial
  IGFBP-2 heparin binding domain-containing peptide sequence
RRRVGVEEPHK

SEQ ID NO: 4135 - protein, 11 aa, Artificial
  IGFBP-2 heparin binding domain-containing peptide sequence
HRRVGVEEPHK

SEQ ID NO: 4136 - protein, 11 aa, Artificial
  IGFBP-2 heparin binding domain-containing peptide sequence
KHHLGLNEPHK

SEQ ID NO: 4137 - protein, 11 aa, Artificial
  IGFBP-2 heparin binding domain-containing peptide sequence
RHHLGLNEPHK

SEQ ID NO: 4138 - protein, 11 aa, Artificial
  IGFBP-2 heparin binding domain-containing peptide sequence
HHHLGLNEPHK

SEQ ID NO: 4139 - protein, 11 aa, Artificial
  IGFBP-2 heparin binding domain-containing peptide sequence
KKHLGLNEPHK

SEQ ID NO: 4140 - protein, 11 aa, Artificial
  IGFBP-2 heparin binding domain-containing peptide sequence
RKHLGLNEPHK

SEQ ID NO: 4141 - protein, 11 aa, Artificial
  IGFBP-2 heparin binding domain-containing peptide sequence
HKHLGLNEPHK

SEQ ID NO: 4142 - protein, 11 aa, Artificial
  IGFBP-2 heparin binding domain-containing peptide sequence
KRHLGLNEPHK

SEQ ID NO: 4143 - protein, 11 aa, Artificial
  IGFBP-2 heparin binding domain-containing peptide sequence
RRHLGLNEPHK

SEQ ID NO: 4144 - protein, 11 aa, Artificial
  IGFBP-2 heparin binding domain-containing peptide sequence
HRHLGLNEPHK

SEQ ID NO: 4145 - protein, 11 aa, Artificial
  IGFBP-2 heparin binding domain-containing peptide sequence
KHKLGLNEPHK

SEQ ID NO: 4146 - protein, 11 aa, Artificial
  IGFBP-2 heparin binding domain-containing peptide sequence
RHKLGLNEPHK

SEQ ID NO: 4147 - protein, 11 aa, Artificial
  IGFBP-2 heparin binding domain-containing peptide sequence
HHKLGLNEPHK

SEQ ID NO: 4148 - protein, 11 aa, Artificial
  IGFBP-2 heparin binding domain-containing peptide sequence
KKKLGLNEPHK

SEQ ID NO: 4149 - protein, 11 aa, Artificial
  IGFBP-2 heparin binding domain-containing peptide sequence
RKKLGLNEPHK

SEQ ID NO: 4150 - protein, 11 aa, Artificial
  IGFBP-2 heparin binding domain-containing peptide sequence
HKKLGLNEPHK

SEQ ID NO: 4151 - protein, 11 aa, Artificial
  IGFBP-2 heparin binding domain-containing peptide sequence
KRKLGLNEPHK

SEQ ID NO: 4152 - protein, 11 aa, Artificial
  IGFBP-2 heparin binding domain-containing peptide sequence
RRKLGLNEPHK

SEQ ID NO: 4153 - protein, 11 aa, Artificial
  IGFBP-2 heparin binding domain-containing peptide sequence
HRKLGLNEPHK

SEQ ID NO: 4154 - protein, 11 aa, Artificial
  IGFBP-2 heparin binding domain-containing peptide sequence
KHRLGLNEPHK

SEQ ID NO: 4155 - protein, 11 aa, Artificial
  IGFBP-2 heparin binding domain-containing peptide sequence
RHRLGLNEPHK

SEQ ID NO: 4156 - protein, 11 aa, Artificial
  IGFBP-2 heparin binding domain-containing peptide sequence
HHRLGLNEPHK

SEQ ID NO: 4157 - protein, 11 aa, Artificial
  IGFBP-2 heparin binding domain-containing peptide sequence
KKRLGLNEPHK

SEQ ID NO: 4158 - protein, 11 aa, Artificial
  IGFBP-2 heparin binding domain-containing peptide sequence
RKRLGLNEPHK

SEQ ID NO: 4159 - protein, 11 aa, Artificial
  IGFBP-2 heparin binding domain-containing peptide sequence
HKRLGLNEPHK

SEQ ID NO: 4160 - protein, 11 aa, Artificial
  IGFBP-2 heparin binding domain-containing peptide sequence
KRRLGLNEPHK

SEQ ID NO: 4161 - protein, 11 aa, Artificial
  IGFBP-2 heparin binding domain-containing peptide sequence
RRRLGLNEPHK

SEQ ID NO: 4162 - protein, 11 aa, Artificial
  IGFBP-2 heparin binding domain-containing peptide sequence
HRRLGLNEPHK

SEQ ID NO: 4163 - protein, 10 aa, Artificial
  IGFBP-2 heparin binding domain-containing peptide sequence
KHHIGLNPHK

SEQ ID NO: 4164 - protein, 11 aa, Artificial
  IGFBP-2 heparin binding domain-containing peptide sequence
RHHIGLNEPHK

SEQ ID NO: 4165 - protein, 11 aa, Artificial
  IGFBP-2 heparin binding domain-containing peptide sequence
HHHIGLNEPHK

SEQ ID NO: 4166 - protein, 11 aa, Artificial
  IGFBP-2 heparin binding domain-containing peptide sequence
KKHIGLNEPHK

SEQ ID NO: 4167 - protein, 11 aa, Artificial
  IGFBP-2 heparin binding domain-containing peptide sequence
RKHIGLNEPHK

SEQ ID NO: 4168 - protein, 11 aa, Artificial
  IGFBP-2 heparin binding domain-containing peptide sequence
HKHIGLNEPHK

SEQ ID NO: 4169 - protein, 11 aa, Artificial
  IGFBP-2 heparin binding domain-containing peptide sequence
KRHIGLNEPHK

SEQ ID NO: 4170 - protein, 11 aa, Artificial
  IGFBP-2 heparin binding domain-containing peptide sequence
RRHIGLNEPHK

SEQ ID NO: 4171 - protein, 11 aa, Artificial
  IGFBP-2 heparin binding domain-containing peptide sequence
HRHIGLNEPHK

SEQ ID NO: 4172 - protein, 11 aa, Artificial
  IGFBP-2 heparin binding domain-containing peptide sequence
KHKIGLNEPHK

SEQ ID NO: 4173 - protein, 11 aa, Artificial
  IGFBP-2 heparin binding domain-containing peptide sequence
RHKIGLNEPHK

SEQ ID NO: 4174 - protein, 11 aa, Artificial
  IGFBP-2 heparin binding domain-containing peptide sequence
HHKIGLNEPHK

SEQ ID NO: 4175 - protein, 11 aa, Artificial
  IGFBP-2 heparin binding domain-containing peptide sequence
KKKIGLNEPHK

SEQ ID NO: 4176 - protein, 11 aa, Artificial
  IGFBP-2 heparin binding domain-containing peptide sequence
RKKIGLNEPHK

SEQ ID NO: 4177 - protein, 11 aa, Artificial
  IGFBP-2 heparin binding domain-containing peptide sequence
HKKIGLNEPHK

SEQ ID NO: 4178 - protein, 11 aa, Artificial
  IGFBP-2 heparin binding domain-containing peptide sequence
KRKIGLNEPHK

SEQ ID NO: 4179 - protein, 11 aa, Artificial
  IGFBP-2 heparin binding domain-containing peptide sequence
RRKIGLNEPHK

SEQ ID NO: 4180 - protein, 11 aa, Artificial
  IGFBP-2 heparin binding domain-containing peptide sequence
HRKIGLNEPHK

SEQ ID NO: 4181 - protein, 11 aa, Artificial
  IGFBP-2 heparin binding domain-containing peptide sequence
KHRIGLNEPHK

SEQ ID NO: 4182 - protein, 11 aa, Artificial
  IGFBP-2 heparin binding domain-containing peptide sequence
RHRIGLNEPHK

SEQ ID NO: 4183 - protein, 11 aa, Artificial
  IGFBP-2 heparin binding domain-containing peptide sequence
HHRIGLNEPHK

SEQ ID NO: 4184 - protein, 11 aa, Artificial
  IGFBP-2 heparin binding domain-containing peptide sequence
KKRIGLNEPHK

SEQ ID NO: 4185 - protein, 11 aa, Artificial
  IGFBP-2 heparin binding domain-containing peptide sequence
RKRIGLNEPHK

SEQ ID NO: 4186 - protein, 11 aa, Artificial
  IGFBP-2 heparin binding domain-containing peptide sequence
HKRIGLNEPHK

SEQ ID NO: 4187 - protein, 11 aa, Artificial
  IGFBP-2 heparin binding domain-containing peptide sequence
KRRIGLNEPHK

SEQ ID NO: 4188 - protein, 11 aa, Artificial
  IGFBP-2 heparin binding domain-containing peptide sequence
RRRIGLNEPHK

SEQ ID NO: 4189 - protein, 11 aa, Artificial
  IGFBP-2 heparin binding domain-containing peptide sequence
HRRIGLNEPHK

SEQ ID NO: 4190 - protein, 11 aa, Artificial
  IGFBP-2 heparin binding domain-containing peptide sequence
KHHVGLNEPHK

SEQ ID NO: 4191 - protein, 11 aa, Artificial
  IGFBP-2 heparin binding domain-containing peptide sequence
RHHVGLNEPHK

SEQ ID NO: 4192 - protein, 11 aa, Artificial
  IGFBP-2 heparin binding domain-containing peptide sequence
HHHVGLNEPHK

SEQ ID NO: 4193 - protein, 11 aa, Artificial
  IGFBP-2 heparin binding domain-containing peptide sequence
KKHVGLNEPHK

SEQ ID NO: 4194 - protein, 11 aa, Artificial
  IGFBP-2 heparin binding domain-containing peptide sequence
RKHVGLNEPHK

SEQ ID NO: 4195 - protein, 11 aa, Artificial
  IGFBP-2 heparin binding domain-containing peptide sequence
HKHVGLNEPHK

SEQ ID NO: 4196 - protein, 11 aa, Artificial
  IGFBP-2 heparin binding domain-containing peptide sequence
KRHVGLNEPHK

SEQ ID NO: 4197 - protein, 11 aa, Artificial
  IGFBP-2 heparin binding domain-containing peptide sequence
RRHVGLNEPHK

SEQ ID NO: 4198 - protein, 11 aa, Artificial
  IGFBP-2 heparin binding domain-containing peptide sequence
HRHVGLNEPHK

SEQ ID NO: 4199 - protein, 11 aa, Artificial
  IGFBP-2 heparin binding domain-containing peptide sequence
KHKVGLNEPHK

SEQ ID NO: 4200 - protein, 11 aa, Artificial
  IGFBP-2 heparin binding domain-containing peptide sequence
RHKVGLNEPHK

SEQ ID NO: 4201 - protein, 11 aa, Artificial
  IGFBP-2 heparin binding domain-containing peptide sequence
HHKVGLNEPHK

SEQ ID NO: 4202 - protein, 11 aa, Artificial
  IGFBP-2 heparin binding domain-containing peptide sequence
KKKVGLNEPHK

SEQ ID NO: 4203 - protein, 11 aa, Artificial
  IGFBP-2 heparin binding domain-containing peptide sequence
RKKVGLNEPHK

SEQ ID NO: 4204 - protein, 11 aa, Artificial
  IGFBP-2 heparin binding domain-containing peptide sequence
HKKVGLNEPHK

SEQ ID NO: 4205 - protein, 11 aa, Artificial
  IGFBP-2 heparin binding domain-containing peptide sequence
KRKVGLNEPHK

SEQ ID NO: 4206 - protein, 11 aa, Artificial
  IGFBP-2 heparin binding domain-containing peptide sequence
RRKVGLNEPHK

SEQ ID NO: 4207 - protein, 11 aa, Artificial
  IGFBP-2 heparin binding domain-containing peptide sequence
HRKVGLNEPHK

SEQ ID NO: 4208 - protein, 11 aa, Artificial
  IGFBP-2 heparin binding domain-containing peptide sequence
KHRVGLNEPHK

SEQ ID NO: 4209 - protein, 11 aa, Artificial
  IGFBP-2 heparin binding domain-containing peptide sequence
RHRVGLNEPHK

SEQ ID NO: 4210 - protein, 11 aa, Artificial
  IGFBP-2 heparin binding domain-containing peptide sequence
HHRVGLNEPHK

SEQ ID NO: 4211 - protein, 11 aa, Artificial
  IGFBP-2 heparin binding domain-containing peptide sequence
KKRVGLNEPHK

SEQ ID NO: 4212 - protein, 11 aa, Artificial
  IGFBP-2 heparin binding domain-containing peptide sequence
RKRVGLNEPHK

SEQ ID NO: 4213 - protein, 11 aa, Artificial
  IGFBP-2 heparin binding domain-containing peptide sequence
HKRVGLNEPHK

SEQ ID NO: 4214 - protein, 11 aa, Artificial
  IGFBP-2 heparin binding domain-containing peptide sequence
KRRVGLNEPHK

SEQ ID NO: 4215 - protein, 11 aa, Artificial
  IGFBP-2 heparin binding domain-containing peptide sequence
RRRVGLNEPHK

SEQ ID NO: 4216 - protein, 11 aa, Artificial
  IGFBP-2 heparin binding domain-containing peptide sequence
HRRVGLNEPHK

SEQ ID NO: 4217 - protein, 11 aa, Artificial
  IGFBP-2 heparin binding domain-containing peptide sequence
KHHLGINEPHK

SEQ ID NO: 4218 - protein, 11 aa, Artificial
  IGFBP-2 heparin binding domain-containing peptide sequence
RHHLGINEPHK

SEQ ID NO: 4219 - protein, 11 aa, Artificial
  IGFBP-2 heparin binding domain-containing peptide sequence
HHHLGINEPHK

SEQ ID NO: 4220 - protein, 11 aa, Artificial
  IGFBP-2 heparin binding domain-containing peptide sequence
KKHLGINEPHK

SEQ ID NO: 4221 - protein, 11 aa, Artificial
  IGFBP-2 heparin binding domain-containing peptide sequence
RKHLGINEPHK

SEQ ID NO: 4222 - protein, 11 aa, Artificial
  IGFBP-2 heparin binding domain-containing peptide sequence
HKHLGINEPHK

SEQ ID NO: 4223 - protein, 11 aa, Artificial
  IGFBP-2 heparin binding domain-containing peptide sequence
KRHLGINEPHK

SEQ ID NO: 4224 - protein, 11 aa, Artificial
  IGFBP-2 heparin binding domain-containing peptide sequence
RRHLGINEPHK

SEQ ID NO: 4225 - protein, 11 aa, Artificial
  IGFBP-2 heparin binding domain-containing peptide sequence
HRHLGINEPHK

SEQ ID NO: 4226 - protein, 11 aa, Artificial
  IGFBP-2 heparin binding domain-containing peptide sequence
KHKLGINEPHK

SEQ ID NO: 4227 - protein, 11 aa, Artificial
  IGFBP-2 heparin binding domain-containing peptide sequence
RHKLGINEPHK

SEQ ID NO: 4228 - protein, 11 aa, Artificial
  IGFBP-2 heparin binding domain-containing peptide sequence
HHKLGINEPHK

SEQ ID NO: 4229 - protein, 11 aa, Artificial
  IGFBP-2 heparin binding domain-containing peptide sequence
KKKLGINEPHK

SEQ ID NO: 4230 - protein, 11 aa, Artificial
  IGFBP-2 heparin binding domain-containing peptide sequence
RKKLGINEPHK

SEQ ID NO: 4231 - protein, 11 aa, Artificial
  IGFBP-2 heparin binding domain-containing peptide sequence
HKKLGINEPHK

SEQ ID NO: 4232 - protein, 11 aa, Artificial
  IGFBP-2 heparin binding domain-containing peptide sequence
KRKLGINEPHK

SEQ ID NO: 4233 - protein, 11 aa, Artificial
  IGFBP-2 heparin binding domain-containing peptide sequence
RRKLGINEPHK

SEQ ID NO: 4234 - protein, 11 aa, Artificial
  IGFBP-2 heparin binding domain-containing peptide sequence
HRKLGINEPHK

SEQ ID NO: 4235 - protein, 11 aa, Artificial
  IGFBP-2 heparin binding domain-containing peptide sequence
KHRLGINEPHK

SEQ ID NO: 4236 - protein, 11 aa, Artificial
  IGFBP-2 heparin binding domain-containing peptide sequence
RHRLGINEPHK

SEQ ID NO: 4237 - protein, 11 aa, Artificial
  IGFBP-2 heparin binding domain-containing peptide sequence
HHRLGINEPHK

SEQ ID NO: 4238 - protein, 11 aa, Artificial
  IGFBP-2 heparin binding domain-containing peptide sequence
KKRLGINEPHK

SEQ ID NO: 4239 - protein, 11 aa, Artificial
  IGFBP-2 heparin binding domain-containing peptide sequence
RKRLGINEPHK

SEQ ID NO: 4240 - protein, 11 aa, Artificial
  IGFBP-2 heparin binding domain-containing peptide sequence
HKRLGINEPHK

SEQ ID NO: 4241 - protein, 11 aa, Artificial
  IGFBP-2 heparin binding domain-containing peptide sequence
KRRLGINEPHK

SEQ ID NO: 4242 - protein, 11 aa, Artificial
  IGFBP-2 heparin binding domain-containing peptide sequence
RRRLGINEPHK

SEQ ID NO: 4243 - protein, 11 aa, Artificial
  IGFBP-2 heparin binding domain-containing peptide sequence
HRRLGINEPHK

SEQ ID NO: 4244 - protein, 11 aa, Artificial
  IGFBP-2 heparin binding domain-containing peptide sequence
KHHIGIENPHK

SEQ ID NO: 4245 - protein, 11 aa, Artificial
  IGFBP-2 heparin binding domain-containing peptide sequence
RHHIGINEPHK

SEQ ID NO: 4246 - protein, 11 aa, Artificial
  IGFBP-2 heparin binding domain-containing peptide sequence
HHHIGINEPHK

SEQ ID NO: 4247 - protein, 11 aa, Artificial
  IGFBP-2 heparin binding domain-containing peptide sequence
KKHIGINEPHK

SEQ ID NO: 4248 - protein, 11 aa, Artificial
  IGFBP-2 heparin binding domain-containing peptide sequence
RKHIGINEPHK

SEQ ID NO: 4249 - protein, 11 aa, Artificial
  IGFBP-2 heparin binding domain-containing peptide sequence
HKHIGINEPHK

SEQ ID NO: 4250 - protein, 11 aa, Artificial
  IGFBP-2 heparin binding domain-containing peptide sequence
KRHIGINEPHK

SEQ ID NO: 4251 - protein, 11 aa, Artificial
  IGFBP-2 heparin binding domain-containing peptide sequence
RRHIGINEPHK

SEQ ID NO: 4252 - protein, 11 aa, Artificial
  IGFBP-2 heparin binding domain-containing peptide sequence
HRHIGINEPHK

SEQ ID NO: 4253 - protein, 11 aa, Artificial
  IGFBP-2 heparin binding domain-containing peptide sequence
KHKIGINEPHK

SEQ ID NO: 4254 - protein, 11 aa, Artificial
  IGFBP-2 heparin binding domain-containing peptide sequence
RHKIGINEPHK

SEQ ID NO: 4255 - protein, 11 aa, Artificial
  IGFBP-2 heparin binding domain-containing peptide sequence
HHKIGINEPHK

SEQ ID NO: 4256 - protein, 11 aa, Artificial
  IGFBP-2 heparin binding domain-containing peptide sequence
KKKIGINEPHK

SEQ ID NO: 4257 - protein, 11 aa, Artificial
  IGFBP-2 heparin binding domain-containing peptide sequence
RKKIGINEPHK

SEQ ID NO: 4258 - protein, 11 aa, Artificial
  IGFBP-2 heparin binding domain-containing peptide sequence
HKKIGINEPHK

SEQ ID NO: 4259 - protein, 11 aa, Artificial
  IGFBP-2 heparin binding domain-containing peptide sequence
KRKIGINEPHK

SEQ ID NO: 4260 - protein, 11 aa, Artificial
  IGFBP-2 heparin binding domain-containing peptide sequence
RRKIGINEPHK

SEQ ID NO: 4261 - protein, 11 aa, Artificial
  IGFBP-2 heparin binding domain-containing peptide sequence
HRKIGINEPHK

SEQ ID NO: 4262 - protein, 11 aa, Artificial
  IGFBP-2 heparin binding domain-containing peptide sequence
KHRIGINEPHK

SEQ ID NO: 4263 - protein, 11 aa, Artificial
  IGFBP-2 heparin binding domain-containing peptide sequence
RHRIGINEPHK

SEQ ID NO: 4264 - protein, 11 aa, Artificial
  IGFBP-2 heparin binding domain-containing peptide sequence
HHRIGINEPHK

SEQ ID NO: 4265 - protein, 11 aa, Artificial
  IGFBP-2 heparin binding domain-containing peptide sequence
KKRIGINEPHK

SEQ ID NO: 4266 - protein, 11 aa, Artificial
  IGFBP-2 heparin binding domain-containing peptide sequence
RKRIGINEPHK

SEQ ID NO: 4267 - protein, 11 aa, Artificial
  IGFBP-2 heparin binding domain-containing peptide sequence
HKRIGINEPHK

SEQ ID NO: 4268 - protein, 11 aa, Artificial
  IGFBP-2 heparin binding domain-containing peptide sequence
KRRIGINEPHK

SEQ ID NO: 4269 - protein, 11 aa, Artificial
  IGFBP-2 heparin binding domain-containing peptide sequence
RRRIGINEPHK

SEQ ID NO: 4270 - protein, 11 aa, Artificial
  IGFBP-2 heparin binding domain-containing peptide sequence
HRRIGINEPHK

SEQ ID NO: 4271 - protein, 11 aa, Artificial
  IGFBP-2 heparin binding domain-containing peptide sequence
KHHVGINEPHK

SEQ ID NO: 4272 - protein, 11 aa, Artificial
  IGFBP-2 heparin binding domain-containing peptide sequence
RHHVGINEPHK

SEQ ID NO: 4273 - protein, 11 aa, Artificial
  IGFBP-2 heparin binding domain-containing peptide sequence
HHHVGINEPHK

SEQ ID NO: 4274 - protein, 11 aa, Artificial
  IGFBP-2 heparin binding domain-containing peptide sequence
KKHVGINEPHK

SEQ ID NO: 4275 - protein, 11 aa, Artificial
  IGFBP-2 heparin binding domain-containing peptide sequence
RKHVGINEPHK

SEQ ID NO: 4276 - protein, 11 aa, Artificial
  IGFBP-2 heparin binding domain-containing peptide sequence
HKHVGINEPHK

SEQ ID NO: 4277 - protein, 11 aa, Artificial
  IGFBP-2 heparin binding domain-containing peptide sequence
KRHVGINEPHK

SEQ ID NO: 4278 - protein, 11 aa, Artificial
  IGFBP-2 heparin binding domain-containing peptide sequence
RRHVGINEPHK

SEQ ID NO: 4279 - protein, 11 aa, Artificial
  IGFBP-2 heparin binding domain-containing peptide sequence
HRHVGINEPHK

SEQ ID NO: 4280 - protein, 11 aa, Artificial
  IGFBP-2 heparin binding domain-containing peptide sequence
KHKVGINEPHK

SEQ ID NO: 4281 - protein, 11 aa, Artificial
  IGFBP-2 heparin binding domain-containing peptide sequence
RHKVGINEPHK

SEQ ID NO: 4282 - protein, 11 aa, Artificial
  IGFBP-2 heparin binding domain-containing peptide sequence
HHKVGINEPHK

SEQ ID NO: 4283 - protein, 11 aa, Artificial
  IGFBP-2 heparin binding domain-containing peptide sequence
KKKVGINEPHK

SEQ ID NO: 4284 - protein, 11 aa, Artificial
  IGFBP-2 heparin binding domain-containing peptide sequence
RKKVGINEPHK

SEQ ID NO: 4285 - protein, 11 aa, Artificial
  IGFBP-2 heparin binding domain-containing peptide sequence
HKKVGINEPHK

SEQ ID NO: 4286 - protein, 11 aa, Artificial
  IGFBP-2 heparin binding domain-containing peptide sequence
KRKVGINEPHK

SEQ ID NO: 4287 - protein, 11 aa, Artificial
  IGFBP-2 heparin binding domain-containing peptide sequence
RRKVGINEPHK

SEQ ID NO: 4288 - protein, 11 aa, Artificial
  IGFBP-2 heparin binding domain-containing peptide sequence
HRKVGINEPHK

SEQ ID NO: 4289 - protein, 11 aa, Artificial
  IGFBP-2 heparin binding domain-containing peptide sequence
KHRVGINEPHK

SEQ ID NO: 4290 - protein, 11 aa, Artificial
  IGFBP-2 heparin binding domain-containing peptide sequence
RHRVGINEPHK

SEQ ID NO: 4291 - protein, 11 aa, Artificial
  IGFBP-2 heparin binding domain-containing peptide sequence
HHRVGINEPHK

SEQ ID NO: 4292 - protein, 11 aa, Artificial
  IGFBP-2 heparin binding domain-containing peptide sequence
KKRVGINEPHK

SEQ ID NO: 4293 - protein, 11 aa, Artificial
  IGFBP-2 heparin binding domain-containing peptide sequence
RKRVGINEPHK

SEQ ID NO: 4294 - protein, 11 aa, Artificial
  IGFBP-2 heparin binding domain-containing peptide sequence
HKRVGINEPHK

SEQ ID NO: 4295 - protein, 11 aa, Artificial
  IGFBP-2 heparin binding domain-containing peptide sequence
KRRVGINEPHK

SEQ ID NO: 4296 - protein, 11 aa, Artificial
  IGFBP-2 heparin binding domain-containing peptide sequence
RRRVGINEPHK

SEQ ID NO: 4297 - protein, 11 aa, Artificial
  IGFBP-2 heparin binding domain-containing peptide sequence
HRRVGINEPHK

SEQ ID NO: 4298 - protein, 11 aa, Artificial
  IGFBP-2 heparin binding domain-containing peptide sequence
KHHLGVNEPHK

SEQ ID NO: 4299 - protein, 11 aa, Artificial
  IGFBP-2 heparin binding domain-containing peptide sequence
RHHLGVNEPHK

SEQ ID NO: 4300 - protein, 11 aa, Artificial
  IGFBP-2 heparin binding domain-containing peptide sequence
HHHLGVNEPHK

SEQ ID NO: 4301 - protein, 11 aa, Artificial
  IGFBP-2 heparin binding domain-containing peptide sequence
KKHLGVNEPHK

SEQ ID NO: 4302 - protein, 11 aa, Artificial
  IGFBP-2 heparin binding domain-containing peptide sequence
RKHLGVNEPHK

SEQ ID NO: 4303 - protein, 11 aa, Artificial
  IGFBP-2 heparin binding domain-containing peptide sequence
HKHLGVNEPHK

SEQ ID NO: 4304 - protein, 11 aa, Artificial
  IGFBP-2 heparin binding domain-containing peptide sequence
KRHLGVNEPHK

SEQ ID NO: 4305 - protein, 11 aa, Artificial
  IGFBP-2 heparin binding domain-containing peptide sequence
RRHLGVNEPHK

SEQ ID NO: 4306 - protein, 11 aa, Artificial
  IGFBP-2 heparin binding domain-containing peptide sequence
HRHLGVNEPHK

SEQ ID NO: 4307 - protein, 11 aa, Artificial
  IGFBP-2 heparin binding domain-containing peptide sequence
KHKLGVNEPHK

SEQ ID NO: 4308 - protein, 11 aa, Artificial
  IGFBP-2 heparin binding domain-containing peptide sequence
RHKLGVNEPHK

SEQ ID NO: 4309 - protein, 11 aa, Artificial
  IGFBP-2 heparin binding domain-containing peptide sequence
HHKLGVNEPHK

SEQ ID NO: 4310 - protein, 11 aa, Artificial
  IGFBP-2 heparin binding domain-containing peptide sequence
KKKLGVNEPHK

SEQ ID NO: 4311 - protein, 11 aa, Artificial
  IGFBP-2 heparin binding domain-containing peptide sequence
RKKLGVNEPHK

SEQ ID NO: 4312 - protein, 11 aa, Artificial
  IGFBP-2 heparin binding domain-containing peptide sequence
HKKLGVNEPHK

SEQ ID NO: 4313 - protein, 11 aa, Artificial
  IGFBP-2 heparin binding domain-containing peptide sequence
KRKLGVNEPHK

SEQ ID NO: 4314 - protein, 11 aa, Artificial
  IGFBP-2 heparin binding domain-containing peptide sequence
RRKLGVNEPHK

SEQ ID NO: 4315 - protein, 11 aa, Artificial
  IGFBP-2 heparin binding domain-containing peptide sequence
HRKLGVNEPHK

SEQ ID NO: 4316 - protein, 11 aa, Artificial
  IGFBP-2 heparin binding domain-containing peptide sequence
KHRLGVNEPHK

SEQ ID NO: 4317 - protein, 11 aa, Artificial
  IGFBP-2 heparin binding domain-containing peptide sequence
RHRLGVNEPHK

SEQ ID NO: 4318 - protein, 11 aa, Artificial
  IGFBP-2 heparin binding domain-containing peptide sequence
HHRLGVNEPHK

SEQ ID NO: 4319 - protein, 11 aa, Artificial
  IGFBP-2 heparin binding domain-containing peptide sequence
KKRLGVNEPHK

SEQ ID NO: 4320 - protein, 11 aa, Artificial
  IGFBP-2 heparin binding domain-containing peptide sequence
RKRLGVNEPHK

SEQ ID NO: 4321 - protein, 11 aa, Artificial
  IGFBP-2 heparin binding domain-containing peptide sequence
HKRLGVNEPHK

SEQ ID NO: 4322 - protein, 11 aa, Artificial
  IGFBP-2 heparin binding domain-containing peptide sequence
KRRLGVNEPHK

SEQ ID NO: 4323 - protein, 11 aa, Artificial
  IGFBP-2 heparin binding domain-containing peptide sequence
RRRLGVNEPHK

SEQ ID NO: 4324 - protein, 11 aa, Artificial
  IGFBP-2 heparin binding domain-containing peptide sequence
HRRLGVNEPHK

SEQ ID NO: 4325 - protein, 11 aa, Artificial
  IGFBP-2 heparin binding domain-containing peptide sequence
KHHIGVNEPHK

SEQ ID NO: 4326 - protein, 11 aa, Artificial
  IGFBP-2 heparin binding domain-containing peptide sequence
RHHIGVNEPHK

SEQ ID NO: 4327 - protein, 11 aa, Artificial
  IGFBP-2 heparin binding domain-containing peptide sequence
HHHIGVNEPHK

SEQ ID NO: 4328 - protein, 11 aa, Artificial
  IGFBP-2 heparin binding domain-containing peptide sequence
KKHIGVNEPHK

SEQ ID NO: 4329 - protein, 11 aa, Artificial
  IGFBP-2 heparin binding domain-containing peptide sequence
RKHIGVNEPHK

SEQ ID NO: 4330 - protein, 11 aa, Artificial
  IGFBP-2 heparin binding domain-containing peptide sequence
HKHIGVNEPHK

SEQ ID NO: 4331 - protein, 11 aa, Artificial
  IGFBP-2 heparin binding domain-containing peptide sequence
KRHIGVNEPHK

SEQ ID NO: 4332 - protein, 11 aa, Artificial
  IGFBP-2 heparin binding domain-containing peptide sequence
RRHIGVNEPHK

SEQ ID NO: 4333 - protein, 11 aa, Artificial
  IGFBP-2 heparin binding domain-containing peptide sequence
HRHIGVNEPHK

SEQ ID NO: 4334 - protein, 11 aa, Artificial
  IGFBP-2 heparin binding domain-containing peptide sequence
KHKIGVNEPHK

SEQ ID NO: 4335 - protein, 11 aa, Artificial
  IGFBP-2 heparin binding domain-containing peptide sequence
RHKIGVNEPHK

SEQ ID NO: 4336 - protein, 11 aa, Artificial
  IGFBP-2 heparin binding domain-containing peptide sequence
HHKIGVNEPHK

SEQ ID NO: 4337 - protein, 11 aa, Artificial
  IGFBP-2 heparin binding domain-containing peptide sequence
KKKIGVNEPHK

SEQ ID NO: 4338 - protein, 11 aa, Artificial
  IGFBP-2 heparin binding domain-containing peptide sequence
RKKIGVNEPHK

SEQ ID NO: 4339 - protein, 11 aa, Artificial
  IGFBP-2 heparin binding domain-containing peptide sequence
HKKIGVNEPHK

SEQ ID NO: 4340 - protein, 11 aa, Artificial
  IGFBP-2 heparin binding domain-containing peptide sequence
KRKIGVNEPHK

SEQ ID NO: 4341 - protein, 11 aa, Artificial
  IGFBP-2 heparin binding domain-containing peptide sequence
RRKIGVNEPHK

SEQ ID NO: 4342 - protein, 11 aa, Artificial
  IGFBP-2 heparin binding domain-containing peptide sequence
HRKIGVNEPHK

SEQ ID NO: 4343 - protein, 11 aa, Artificial
  IGFBP-2 heparin binding domain-containing peptide sequence
KHRIGVNEPHK

SEQ ID NO: 4344 - protein, 11 aa, Artificial
  IGFBP-2 heparin binding domain-containing peptide sequence
RHRIGVNEPHK

SEQ ID NO: 4345 - protein, 11 aa, Artificial
  IGFBP-2 heparin binding domain-containing peptide sequence
HHRIGVNEPHK

SEQ ID NO: 4346 - protein, 11 aa, Artificial
  IGFBP-2 heparin binding domain-containing peptide sequence
KKRIGVNEPHK

SEQ ID NO: 4347 - protein, 11 aa, Artificial
  IGFBP-2 heparin binding domain-containing peptide sequence
RKRIGVNEPHK

SEQ ID NO: 4348 - protein, 11 aa, Artificial
  IGFBP-2 heparin binding domain-containing peptide sequence
HKRIGVNEPHK

SEQ ID NO: 4349 - protein, 11 aa, Artificial
  IGFBP-2 heparin binding domain-containing peptide sequence
KRRIGVNEPHK

SEQ ID NO: 4350 - protein, 11 aa, Artificial
  IGFBP-2 heparin binding domain-containing peptide sequence
RRRIGVNEPHK

SEQ ID NO: 4351 - protein, 11 aa, Artificial
  IGFBP-2 heparin binding domain-containing peptide sequence
HRRIGVNEPHK

SEQ ID NO: 4352 - protein, 11 aa, Artificial
  IGFBP-2 heparin binding domain-containing peptide sequence
KHHVGVNEPHK

SEQ ID NO: 4353 - protein, 11 aa, Artificial
  IGFBP-2 heparin binding domain-containing peptide sequence
RHHVGVNEPHK

SEQ ID NO: 4354 - protein, 11 aa, Artificial
  IGFBP-2 heparin binding domain-containing peptide sequence
HHHVGVNEPHK

SEQ ID NO: 4355 - protein, 11 aa, Artificial
  IGFBP-2 heparin binding domain-containing peptide sequence
KKHVGVNEPHK

SEQ ID NO: 4356 - protein, 11 aa, Artificial
  IGFBP-2 heparin binding domain-containing peptide sequence
RKHVGVNEPHK

SEQ ID NO: 4357 - protein, 11 aa, Artificial
  IGFBP-2 heparin binding domain-containing peptide sequence
HKHVGVNEPHK

SEQ ID NO: 4358 - protein, 11 aa, Artificial
  IGFBP-2 heparin binding domain-containing peptide sequence
KRHVGVNEPHK

SEQ ID NO: 4359 - protein, 11 aa, Artificial
  IGFBP-2 heparin binding domain-containing peptide sequence
RRHVGVNEPHK

SEQ ID NO: 4360 - protein, 11 aa, Artificial
  IGFBP-2 heparin binding domain-containing peptide sequence
HRHVGVNEPHK

SEQ ID NO: 4361 - protein, 11 aa, Artificial
  IGFBP-2 heparin binding domain-containing peptide sequence
KHKVGVNEPHK

SEQ ID NO: 4362 - protein, 11 aa, Artificial
  IGFBP-2 heparin binding domain-containing peptide sequence
RHKVGVNEPHK

SEQ ID NO: 4363 - protein, 11 aa, Artificial
  IGFBP-2 heparin binding domain-containing peptide sequence
HHKVGVNEPHK

SEQ ID NO: 4364 - protein, 11 aa, Artificial
  IGFBP-2 heparin binding domain-containing peptide sequence
KKKVGVNEPHK

SEQ ID NO: 4365 - protein, 11 aa, Artificial
  IGFBP-2 heparin binding domain-containing peptide sequence
RKKVGVNEPHK

SEQ ID NO: 4366 - protein, 11 aa, Artificial
  IGFBP-2 heparin binding domain-containing peptide sequence
HKKVGVNEPHK

SEQ ID NO: 4367 - protein, 11 aa, Artificial
  IGFBP-2 heparin binding domain-containing peptide sequence
KRKVGVNEPHK

SEQ ID NO: 4368 - protein, 11 aa, Artificial
  IGFBP-2 heparin binding domain-containing peptide sequence
RRKVGVNEPHK

SEQ ID NO: 4369 - protein, 11 aa, Artificial
  IGFBP-2 heparin binding domain-containing peptide sequence
HRKVGVNEPHK

SEQ ID NO: 4370 - protein, 11 aa, Artificial
  IGFBP-2 heparin binding domain-containing peptide sequence
KHRVGVNEPHK

SEQ ID NO: 4371 - protein, 11 aa, Artificial
  IGFBP-2 heparin binding domain-containing peptide sequence
RHRVGVNEPHK

SEQ ID NO: 4372 - protein, 11 aa, Artificial
  IGFBP-2 heparin binding domain-containing peptide sequence
HHRVGVNEPHK

SEQ ID NO: 4373 - protein, 11 aa, Artificial
  IGFBP-2 heparin binding domain-containing peptide sequence
KKRVGVNEPHK

SEQ ID NO: 4374 - protein, 11 aa, Artificial
  IGFBP-2 heparin binding domain-containing peptide sequence
RKRVGVNEPHK

SEQ ID NO: 4375 - protein, 11 aa, Artificial
  IGFBP-2 heparin binding domain-containing peptide sequence
HKRVGVNEPHK

SEQ ID NO: 4376 - protein, 11 aa, Artificial
  IGFBP-2 heparin binding domain-containing peptide sequence
KRRVGVNEPHK

SEQ ID NO: 4377 - protein, 11 aa, Artificial
  IGFBP-2 heparin binding domain-containing peptide sequence
RRRVGVNEPHK

SEQ ID NO: 4378 - protein, 11 aa, Artificial
  IGFBP-2 heparin binding domain-containing peptide sequence
HRRVGVNEPHK

SEQ ID NO: 4379 - protein, 11 aa, Artificial
  IGFBP-2 heparin binding domain-containing peptide sequence
KHHLGLENPHK

SEQ ID NO: 4380 - protein, 11 aa, Artificial
  IGFBP-2 heparin binding domain-containing peptide sequence
RHHLGLENPHK

SEQ ID NO: 4381 - protein, 11 aa, Artificial
  IGFBP-2 heparin binding domain-containing peptide sequence
HHHLGLENPHK

SEQ ID NO: 4382 - protein, 11 aa, Artificial
  IGFBP-2 heparin binding domain-containing peptide sequence
KKHLGLENPHK

SEQ ID NO: 4383 - protein, 11 aa, Artificial
  IGFBP-2 heparin binding domain-containing peptide sequence
RKHLGLENPHK

SEQ ID NO: 4384 - protein, 11 aa, Artificial
  IGFBP-2 heparin binding domain-containing peptide sequence
HKHLGLENPHK

SEQ ID NO: 4385 - protein, 11 aa, Artificial
  IGFBP-2 heparin binding domain-containing peptide sequence
KRHLGLENPHK

SEQ ID NO: 4386 - protein, 11 aa, Artificial
  IGFBP-2 heparin binding domain-containing peptide sequence
RRHLGLENPHK

SEQ ID NO: 4387 - protein, 11 aa, Artificial
  IGFBP-2 heparin binding domain-containing peptide sequence
HRHLGLENPHK

SEQ ID NO: 4388 - protein, 11 aa, Artificial
  IGFBP-2 heparin binding domain-containing peptide sequence
KHKLGLENPHK

SEQ ID NO: 4389 - protein, 11 aa, Artificial
  IGFBP-2 heparin binding domain-containing peptide sequence
RHKLGLENPHK

SEQ ID NO: 4390 - protein, 11 aa, Artificial
  IGFBP-2 heparin binding domain-containing peptide sequence
HHKLGLENPHK

SEQ ID NO: 4391 - protein, 11 aa, Artificial
  IGFBP-2 heparin binding domain-containing peptide sequence
KKKLGLENPHK

SEQ ID NO: 4392 - protein, 11 aa, Artificial
  IGFBP-2 heparin binding domain-containing peptide sequence
RKKLGLENPHK

SEQ ID NO: 4393 - protein, 11 aa, Artificial
  IGFBP-2 heparin binding domain-containing peptide sequence
HKKLGLENPHK

SEQ ID NO: 4394 - protein, 11 aa, Artificial
  IGFBP-2 heparin binding domain-containing peptide sequence
KRKLGLENPHK

SEQ ID NO: 4395 - protein, 11 aa, Artificial
  IGFBP-2 heparin binding domain-containing peptide sequence
RRKLGLENPHK

SEQ ID NO: 4396 - protein, 11 aa, Artificial
  IGFBP-2 heparin binding domain-containing peptide sequence
HRKLGLENPHK

SEQ ID NO: 4397 - protein, 11 aa, Artificial
  IGFBP-2 heparin binding domain-containing peptide sequence
KHRLGLENPHK

SEQ ID NO: 4398 - protein, 11 aa, Artificial
  IGFBP-2 heparin binding domain-containing peptide sequence
RHRLGLENPHK

SEQ ID NO: 4399 - protein, 11 aa, Artificial
  IGFBP-2 heparin binding domain-containing peptide sequence
HHRLGLENPHK

SEQ ID NO: 4400 - protein, 11 aa, Artificial
  IGFBP-2 heparin binding domain-containing peptide sequence
KKRLGLENPHK

SEQ ID NO: 4401 - protein, 11 aa, Artificial
  IGFBP-2 heparin binding domain-containing peptide sequence
RKRLGLENPHK

SEQ ID NO: 4402 - protein, 11 aa, Artificial
  IGFBP-2 heparin binding domain-containing peptide sequence
HKRLGLENPHK

SEQ ID NO: 4403 - protein, 11 aa, Artificial
  IGFBP-2 heparin binding domain-containing peptide sequence
KRRLGLENPHK

SEQ ID NO: 4404 - protein, 11 aa, Artificial
  IGFBP-2 heparin binding domain-containing peptide sequence
RRRLGLENPHK

SEQ ID NO: 4405 - protein, 11 aa, Artificial
  IGFBP-2 heparin binding domain-containing peptide sequence
HRRLGLENPHK

SEQ ID NO: 4406 - protein, 11 aa, Artificial
  IGFBP-2 heparin binding domain-containing peptide sequence
KHHIGLENPHK

SEQ ID NO: 4407 - protein, 11 aa, Artificial
  IGFBP-2 heparin binding domain-containing peptide sequence
RHHIGLENPHK

SEQ ID NO: 4408 - protein, 11 aa, Artificial
  IGFBP-2 heparin binding domain-containing peptide sequence
HHHIGLENPHK

SEQ ID NO: 4409 - protein, 11 aa, Artificial
  IGFBP-2 heparin binding domain-containing peptide sequence
KKHIGLENPHK

SEQ ID NO: 4410 - protein, 11 aa, Artificial
  IGFBP-2 heparin binding domain-containing peptide sequence
RKHIGLENPHK

SEQ ID NO: 4411 - protein, 11 aa, Artificial
  IGFBP-2 heparin binding domain-containing peptide sequence
HKHIGLENPHK

SEQ ID NO: 4412 - protein, 11 aa, Artificial
  IGFBP-2 heparin binding domain-containing peptide sequence
KRHIGLENPHK

SEQ ID NO: 4413 - protein, 11 aa, Artificial
  IGFBP-2 heparin binding domain-containing peptide sequence
RRHIGLENPHK

SEQ ID NO: 4414 - protein, 11 aa, Artificial
  IGFBP-2 heparin binding domain-containing peptide sequence
HRHIGLENPHK

SEQ ID NO: 4415 - protein, 11 aa, Artificial
  IGFBP-2 heparin binding domain-containing peptide sequence
KHKIGLENPHK

SEQ ID NO: 4416 - protein, 11 aa, Artificial
  IGFBP-2 heparin binding domain-containing peptide sequence
RHKIGLENPHK

SEQ ID NO: 4417 - protein, 11 aa, Artificial
  IGFBP-2 heparin binding domain-containing peptide sequence
HHKIGLENPHK

SEQ ID NO: 4418 - protein, 11 aa, Artificial
  IGFBP-2 heparin binding domain-containing peptide sequence
KKKIGLENPHK

SEQ ID NO: 4419 - protein, 11 aa, Artificial
  IGFBP-2 heparin binding domain-containing peptide sequence
RKKIGLENPHK

SEQ ID NO: 4420 - protein, 11 aa, Artificial
  IGFBP-2 heparin binding domain-containing peptide sequence
HKKIGLENPHK

SEQ ID NO: 4421 - protein, 11 aa, Artificial
  IGFBP-2 heparin binding domain-containing peptide sequence
KRKIGLENPHK

SEQ ID NO: 4422 - protein, 11 aa, Artificial
  IGFBP-2 heparin binding domain-containing peptide sequence
RRKIGLENPHK

SEQ ID NO: 4423 - protein, 11 aa, Artificial
  IGFBP-2 heparin binding domain-containing peptide sequence
HRKIGLENPHK

SEQ ID NO: 4424 - protein, 11 aa, Artificial
  IGFBP-2 heparin binding domain-containing peptide sequence
KHRIGLENPHK

SEQ ID NO: 4425 - protein, 11 aa, Artificial
  IGFBP-2 heparin binding domain-containing peptide sequence
RHRIGLENPHK

SEQ ID NO: 4426 - protein, 11 aa, Artificial
  IGFBP-2 heparin binding domain-containing peptide sequence
HHRIGLENPHK

SEQ ID NO: 4427 - protein, 11 aa, Artificial
  IGFBP-2 heparin binding domain-containing peptide sequence
KKRIGLENPHK

SEQ ID NO: 4428 - protein, 11 aa, Artificial
  IGFBP-2 heparin binding domain-containing peptide sequence
RKRIGLENPHK

SEQ ID NO: 4429 - protein, 11 aa, Artificial
  IGFBP-2 heparin binding domain-containing peptide sequence
HKRIGLENPHK

SEQ ID NO: 4430 - protein, 11 aa, Artificial
  IGFBP-2 heparin binding domain-containing peptide sequence
KRRIGLENPHK

SEQ ID NO: 4431 - protein, 11 aa, Artificial
  IGFBP-2 heparin binding domain-containing peptide sequence
RRRIGLENPHK

SEQ ID NO: 4432 - protein, 11 aa, Artificial
  IGFBP-2 heparin binding domain-containing peptide sequence
HRRIGLENPHK

SEQ ID NO: 4433 - protein, 11 aa, Artificial
  IGFBP-2 heparin binding domain-containing peptide sequence
KHHVGLENPHK

SEQ ID NO: 4434 - protein, 11 aa, Artificial
  IGFBP-2 heparin binding domain-containing peptide sequence
RHHVGLENPHK

SEQ ID NO: 4435 - protein, 11 aa, Artificial
  IGFBP-2 heparin binding domain-containing peptide sequence
HHHVGLENPHK

SEQ ID NO: 4436 - protein, 11 aa, Artificial
  IGFBP-2 heparin binding domain-containing peptide sequence
KKHVGLENPHK

SEQ ID NO: 4437 - protein, 11 aa, Artificial
  IGFBP-2 heparin binding domain-containing peptide sequence
RKHVGLENPHK

SEQ ID NO: 4438 - protein, 11 aa, Artificial
  IGFBP-2 heparin binding domain-containing peptide sequence
HKHVGLENPHK

SEQ ID NO: 4439 - protein, 11 aa, Artificial
  IGFBP-2 heparin binding domain-containing peptide sequence
KRHVGLENPHK

SEQ ID NO: 4440 - protein, 11 aa, Artificial
  IGFBP-2 heparin binding domain-containing peptide sequence
RRHVGLENPHK

SEQ ID NO: 4441 - protein, 11 aa, Artificial
  IGFBP-2 heparin binding domain-containing peptide sequence
HRHVGLENPHK

SEQ ID NO: 4442 - protein, 11 aa, Artificial
  IGFBP-2 heparin binding domain-containing peptide sequence
KHKVGLENPHK

SEQ ID NO: 4443 - protein, 11 aa, Artificial
  IGFBP-2 heparin binding domain-containing peptide sequence
RHKVGLENPHK

SEQ ID NO: 4444 - protein, 11 aa, Artificial
  IGFBP-2 heparin binding domain-containing peptide sequence
HHKVGLENPHK

SEQ ID NO: 4445 - protein, 11 aa, Artificial
  IGFBP-2 heparin binding domain-containing peptide sequence
KKKVGLENPHK

SEQ ID NO: 4446 - protein, 11 aa, Artificial
  IGFBP-2 heparin binding domain-containing peptide sequence
RKKVGLENPHK

SEQ ID NO: 4447 - protein, 11 aa, Artificial
  IGFBP-2 heparin binding domain-containing peptide sequence
HKKVGLENPHK

SEQ ID NO: 4448 - protein, 11 aa, Artificial
  IGFBP-2 heparin binding domain-containing peptide sequence
KRKVGLENPHK

SEQ ID NO: 4449 - protein, 11 aa, Artificial
  IGFBP-2 heparin binding domain-containing peptide sequence
RRKVGLENPHK

SEQ ID NO: 4450 - protein, 11 aa, Artificial
  IGFBP-2 heparin binding domain-containing peptide sequence
HRKVGLENPHK

SEQ ID NO: 4451 - protein, 11 aa, Artificial
  IGFBP-2 heparin binding domain-containing peptide sequence
KHRVGLENPHK

SEQ ID NO: 4452 - protein, 11 aa, Artificial
  IGFBP-2 heparin binding domain-containing peptide sequence
RHRVGLENPHK

SEQ ID NO: 4453 - protein, 11 aa, Artificial
  IGFBP-2 heparin binding domain-containing peptide sequence
HHRVGLENPHK

SEQ ID NO: 4454 - protein, 11 aa, Artificial
  IGFBP-2 heparin binding domain-containing peptide sequence
KKRVGLENPHK

SEQ ID NO: 4455 - protein, 11 aa, Artificial
  IGFBP-2 heparin binding domain-containing peptide sequence
RKRVGLENPHK

SEQ ID NO: 4456 - protein, 11 aa, Artificial
  IGFBP-2 heparin binding domain-containing peptide sequence
HKRVGLENPHK

SEQ ID NO: 4457 - protein, 11 aa, Artificial
  IGFBP-2 heparin binding domain-containing peptide sequence
KRRVGLENPHK

SEQ ID NO: 4458 - protein, 11 aa, Artificial
  IGFBP-2 heparin binding domain-containing peptide sequence
RRRVGLENPHK

SEQ ID NO: 4459 - protein, 11 aa, Artificial
  IGFBP-2 heparin binding domain-containing peptide sequence
HRRVGLENPHK

SEQ ID NO: 4460 - protein, 11 aa, Artificial
  IGFBP-2 heparin binding domain-containing peptide sequence
KHHLGIENPHK

SEQ ID NO: 4461 - protein, 11 aa, Artificial
  IGFBP-2 heparin binding domain-containing peptide sequence
RHHLGIENPHK

SEQ ID NO: 4462 - protein, 11 aa, Artificial
  IGFBP-2 heparin binding domain-containing peptide sequence
HHHLGIENPHK

SEQ ID NO: 4463 - protein, 11 aa, Artificial
  IGFBP-2 heparin binding domain-containing peptide sequence
KKHLGIENPHK

SEQ ID NO: 4464 - protein, 11 aa, Artificial
  IGFBP-2 heparin binding domain-containing peptide sequence
RKHLGIENPHK

SEQ ID NO: 4465 - protein, 11 aa, Artificial
  IGFBP-2 heparin binding domain-containing peptide sequence
HKHLGIENPHK

SEQ ID NO: 4466 - protein, 11 aa, Artificial
  IGFBP-2 heparin binding domain-containing peptide sequence
KRHLGIENPHK

SEQ ID NO: 4467 - protein, 11 aa, Artificial
  IGFBP-2 heparin binding domain-containing peptide sequence
RRHLGIENPHK

SEQ ID NO: 4468 - protein, 11 aa, Artificial
  IGFBP-2 heparin binding domain-containing peptide sequence
HRHLGIENPHK

SEQ ID NO: 4469 - protein, 11 aa, Artificial
  IGFBP-2 heparin binding domain-containing peptide sequence
KHKLGIENPHK

SEQ ID NO: 4470 - protein, 11 aa, Artificial
  IGFBP-2 heparin binding domain-containing peptide sequence
RHKLGIENPHK

SEQ ID NO: 4471 - protein, 11 aa, Artificial
  IGFBP-2 heparin binding domain-containing peptide sequence
HHKLGIENPHK

SEQ ID NO: 4472 - protein, 11 aa, Artificial
  IGFBP-2 heparin binding domain-containing peptide sequence
KKKLGIENPHK

SEQ ID NO: 4473 - protein, 11 aa, Artificial
  IGFBP-2 heparin binding domain-containing peptide sequence
RKKLGIENPHK

SEQ ID NO: 4474 - protein, 11 aa, Artificial
  IGFBP-2 heparin binding domain-containing peptide sequence
HKKLGIENPHK

SEQ ID NO: 4475 - protein, 11 aa, Artificial
  IGFBP-2 heparin binding domain-containing peptide sequence
KRKLGIENPHK

SEQ ID NO: 4476 - protein, 11 aa, Artificial
  IGFBP-2 heparin binding domain-containing peptide sequence
RRKLGIENPHK

SEQ ID NO: 4477 - protein, 11 aa, Artificial
  IGFBP-2 heparin binding domain-containing peptide sequence
HRKLGIENPHK

SEQ ID NO: 4478 - protein, 11 aa, Artificial
  IGFBP-2 heparin binding domain-containing peptide sequence
KHRLGIENPHK

SEQ ID NO: 4479 - protein, 11 aa, Artificial
  IGFBP-2 heparin binding domain-containing peptide sequence
RHRLGIENPHK

SEQ ID NO: 4480 - protein, 11 aa, Artificial
  IGFBP-2 heparin binding domain-containing peptide sequence
HHRLGIENPHK

SEQ ID NO: 4481 - protein, 11 aa, Artificial
  IGFBP-2 heparin binding domain-containing peptide sequence
KKRLGIENPHK

SEQ ID NO: 4482 - protein, 11 aa, Artificial
  IGFBP-2 heparin binding domain-containing peptide sequence
RKRLGIENPHK

SEQ ID NO: 4483 - protein, 11 aa, Artificial
  IGFBP-2 heparin binding domain-containing peptide sequence
HKRLGIENPHK

SEQ ID NO: 4484 - protein, 11 aa, Artificial
  IGFBP-2 heparin binding domain-containing peptide sequence
KRRLGIENPHK

SEQ ID NO: 4485 - protein, 11 aa, Artificial
  IGFBP-2 heparin binding domain-containing peptide sequence
RRRLGIENPHK

SEQ ID NO: 4486 - protein, 11 aa, Artificial
  IGFBP-2 heparin binding domain-containing peptide sequence
HRRLGIENPHK

SEQ ID NO: 4487 - protein, 11 aa, Artificial
  IGFBP-2 heparin binding domain-containing peptide sequence
KHHIGIENPHK

SEQ ID NO: 4488 - protein, 11 aa, Artificial
  IGFBP-2 heparin binding domain-containing peptide sequence
RHHIGIENPHK

SEQ ID NO: 4489 - protein, 11 aa, Artificial
  IGFBP-2 heparin binding domain-containing peptide sequence
HHHIGIENPHK

SEQ ID NO: 4490 - protein, 11 aa, Artificial
  IGFBP-2 heparin binding domain-containing peptide sequence
KKHIGIENPHK

SEQ ID NO: 4491 - protein, 11 aa, Artificial
  IGFBP-2 heparin binding domain-containing peptide sequence
RKHIGIENPHK

SEQ ID NO: 4492 - protein, 11 aa, Artificial
  IGFBP-2 heparin binding domain-containing peptide sequence
HKHIGIENPHK

SEQ ID NO: 4493 - protein, 11 aa, Artificial
  IGFBP-2 heparin binding domain-containing peptide sequence
KRHIGIENPHK

SEQ ID NO: 4494 - protein, 11 aa, Artificial
  IGFBP-2 heparin binding domain-containing peptide sequence
RRHIGIENPHK

SEQ ID NO: 4495 - protein, 11 aa, Artificial
  IGFBP-2 heparin binding domain-containing peptide sequence
HRHIGIENPHK

SEQ ID NO: 4496 - protein, 11 aa, Artificial
  IGFBP-2 heparin binding domain-containing peptide sequence
KHKIGIENPHK

SEQ ID NO: 4497 - protein, 11 aa, Artificial
  IGFBP-2 heparin binding domain-containing peptide sequence
RHKIGIENPHK

SEQ ID NO: 4498 - protein, 11 aa, Artificial
  IGFBP-2 heparin binding domain-containing peptide sequence
HHKIGIENPHK

SEQ ID NO: 4499 - protein, 11 aa, Artificial
  IGFBP-2 heparin binding domain-containing peptide sequence
KKKIGIENPHK

SEQ ID NO: 4500 - protein, 11 aa, Artificial
  IGFBP-2 heparin binding domain-containing peptide sequence
RKKIGIENPHK

SEQ ID NO: 4501 - protein, 11 aa, Artificial
  IGFBP-2 heparin binding domain-containing peptide sequence
HKKIGIENPHK

SEQ ID NO: 4502 - protein, 11 aa, Artificial
  IGFBP-2 heparin binding domain-containing peptide sequence
KRKIGIENPHK

SEQ ID NO: 4503 - protein, 11 aa, Artificial
  IGFBP-2 heparin binding domain-containing peptide sequence
RRKIGIENPHK

SEQ ID NO: 4504 - protein, 11 aa, Artificial
  IGFBP-2 heparin binding domain-containing peptide sequence
HRKIGIENPHK

SEQ ID NO: 4505 - protein, 11 aa, Artificial
  IGFBP-2 heparin binding domain-containing peptide sequence
KHRIGIENPHK

SEQ ID NO: 4506 - protein, 11 aa, Artificial
  IGFBP-2 heparin binding domain-containing peptide sequence
RHRIGIENPHK

SEQ ID NO: 4507 - protein, 11 aa, Artificial
  IGFBP-2 heparin binding domain-containing peptide sequence
HHRIGIENPHK

SEQ ID NO: 4508 - protein, 11 aa, Artificial
  IGFBP-2 heparin binding domain-containing peptide sequence
KKRIGIENPHK

SEQ ID NO: 4509 - protein, 11 aa, Artificial
  IGFBP-2 heparin binding domain-containing peptide sequence
RKRIGIENPHK

SEQ ID NO: 4510 - protein, 11 aa, Artificial
  IGFBP-2 heparin binding domain-containing peptide sequence
HKRIGIENPHK

SEQ ID NO: 4511 - protein, 11 aa, Artificial
  IGFBP-2 heparin binding domain-containing peptide sequence
KRRIGIENPHK

SEQ ID NO: 4512 - protein, 11 aa, Artificial
  IGFBP-2 heparin binding domain-containing peptide sequence
RRRIGIENPHK

SEQ ID NO: 4513 - protein, 11 aa, Artificial
  IGFBP-2 heparin binding domain-containing peptide sequence
HRRIGIENPHK

SEQ ID NO: 4514 - protein, 11 aa, Artificial
  IGFBP-2 heparin binding domain-containing peptide sequence
KHHVGIENPHK

SEQ ID NO: 4515 - protein, 11 aa, Artificial
  IGFBP-2 heparin binding domain-containing peptide sequence
RHHVGIENPHK

SEQ ID NO: 4516 - protein, 11 aa, Artificial
  IGFBP-2 heparin binding domain-containing peptide sequence
HHHVGIENPHK

SEQ ID NO: 4517 - protein, 11 aa, Artificial
  IGFBP-2 heparin binding domain-containing peptide sequence
KKHVGIENPHK

SEQ ID NO: 4518 - protein, 11 aa, Artificial
  IGFBP-2 heparin binding domain-containing peptide sequence
RKHVGIENPHK

SEQ ID NO: 4519 - protein, 11 aa, Artificial
  IGFBP-2 heparin binding domain-containing peptide sequence
HKHVGIENPHK

SEQ ID NO: 4520 - protein, 11 aa, Artificial
  IGFBP-2 heparin binding domain-containing peptide sequence
KRHVGIENPHK

SEQ ID NO: 4521 - protein, 11 aa, Artificial
  IGFBP-2 heparin binding domain-containing peptide sequence
RRHVGIENPHK

SEQ ID NO: 4522 - protein, 11 aa, Artificial
  IGFBP-2 heparin binding domain-containing peptide sequence
HRHVGIENPHK

SEQ ID NO: 4523 - protein, 11 aa, Artificial
  IGFBP-2 heparin binding domain-containing peptide sequence
KHKVGIENPHK

SEQ ID NO: 4524 - protein, 11 aa, Artificial
  IGFBP-2 heparin binding domain-containing peptide sequence
RHKVGIENPHK

SEQ ID NO: 4525 - protein, 11 aa, Artificial
  IGFBP-2 heparin binding domain-containing peptide sequence
HHKVGIENPHK

SEQ ID NO: 4526 - protein, 11 aa, Artificial
  IGFBP-2 heparin binding domain-containing peptide sequence
KKKVGIENPHK

SEQ ID NO: 4527 - protein, 11 aa, Artificial
  IGFBP-2 heparin binding domain-containing peptide sequence
RKKVGIENPHK

SEQ ID NO: 4528 - protein, 11 aa, Artificial
  IGFBP-2 heparin binding domain-containing peptide sequence
HKKVGIENPHK

SEQ ID NO: 4529 - protein, 11 aa, Artificial
  IGFBP-2 heparin binding domain-containing peptide sequence
KRKVGIENPHK

SEQ ID NO: 4530 - protein, 11 aa, Artificial
  IGFBP-2 heparin binding domain-containing peptide sequence
RRKVGIENPHK

SEQ ID NO: 4531 - protein, 11 aa, Artificial
  IGFBP-2 heparin binding domain-containing peptide sequence
HRKVGIENPHK

SEQ ID NO: 4532 - protein, 11 aa, Artificial
  IGFBP-2 heparin binding domain-containing peptide sequence
KHRVGIENPHK

SEQ ID NO: 4533 - protein, 11 aa, Artificial
  IGFBP-2 heparin binding domain-containing peptide sequence
RHRVGIENPHK

SEQ ID NO: 4534 - protein, 11 aa, Artificial
  IGFBP-2 heparin binding domain-containing peptide sequence
HHRVGIENPHK

SEQ ID NO: 4535 - protein, 11 aa, Artificial
  IGFBP-2 heparin binding domain-containing peptide sequence
KKRVGIENPHK

SEQ ID NO: 4536 - protein, 11 aa, Artificial
  IGFBP-2 heparin binding domain-containing peptide sequence
RKRVGIENPHK

SEQ ID NO: 4537 - protein, 11 aa, Artificial
  IGFBP-2 heparin binding domain-containing peptide sequence
HKRVGIENPHK

SEQ ID NO: 4538 - protein, 11 aa, Artificial
  IGFBP-2 heparin binding domain-containing peptide sequence
KRRVGIENPHK

SEQ ID NO: 4539 - protein, 11 aa, Artificial
  IGFBP-2 heparin binding domain-containing peptide sequence
RRRVGIENPHK

SEQ ID NO: 4540 - protein, 11 aa, Artificial
  IGFBP-2 heparin binding domain-containing peptide sequence
HRRVGIENPHK

SEQ ID NO: 4541 - protein, 11 aa, Artificial
  IGFBP-2 heparin binding domain-containing peptide sequence
KHHLGVENPHK

SEQ ID NO: 4542 - protein, 11 aa, Artificial
  IGFBP-2 heparin binding domain-containing peptide sequence
RHHLGVENPHK

SEQ ID NO: 4543 - protein, 11 aa, Artificial
  IGFBP-2 heparin binding domain-containing peptide sequence
HHHLGVENPHK

SEQ ID NO: 4544 - protein, 11 aa, Artificial
  IGFBP-2 heparin binding domain-containing peptide sequence
KKHLGVENPHK

SEQ ID NO: 4545 - protein, 11 aa, Artificial
  IGFBP-2 heparin binding domain-containing peptide sequence
RKHLGVENPHK

SEQ ID NO: 4546 - protein, 11 aa, Artificial
  IGFBP-2 heparin binding domain-containing peptide sequence
HKHLGVENPHK

SEQ ID NO: 4547 - protein, 11 aa, Artificial
  IGFBP-2 heparin binding domain-containing peptide sequence
KRHLGVENPHK

SEQ ID NO: 4548 - protein, 11 aa, Artificial
  IGFBP-2 heparin binding domain-containing peptide sequence
RRHLGVENPHK

SEQ ID NO: 4549 - protein, 11 aa, Artificial
  IGFBP-2 heparin binding domain-containing peptide sequence
HRHLGVENPHK

SEQ ID NO: 4550 - protein, 11 aa, Artificial
  IGFBP-2 heparin binding domain-containing peptide sequence
KHKLGVENPHK

SEQ ID NO: 4551 - protein, 11 aa, Artificial
  IGFBP-2 heparin binding domain-containing peptide sequence
RHKLGVENPHK

SEQ ID NO: 4552 - protein, 11 aa, Artificial
  IGFBP-2 heparin binding domain-containing peptide sequence
HHKLGVENPHK

SEQ ID NO: 4553 - protein, 11 aa, Artificial
  IGFBP-2 heparin binding domain-containing peptide sequence
KKKLGVENPHK

SEQ ID NO: 4554 - protein, 11 aa, Artificial
  IGFBP-2 heparin binding domain-containing peptide sequence
RKKLGVENPHK

SEQ ID NO: 4555 - protein, 11 aa, Artificial
  IGFBP-2 heparin binding domain-containing peptide sequence
HKKLGVENPHK

SEQ ID NO: 4556 - protein, 11 aa, Artificial
  IGFBP-2 heparin binding domain-containing peptide sequence
KRKLGVENPHK

SEQ ID NO: 4557 - protein, 11 aa, Artificial
  IGFBP-2 heparin binding domain-containing peptide sequence
RRKLGVENPHK

SEQ ID NO: 4558 - protein, 11 aa, Artificial
  IGFBP-2 heparin binding domain-containing peptide sequence
HRKLGVENPHK

SEQ ID NO: 4559 - protein, 11 aa, Artificial
  IGFBP-2 heparin binding domain-containing peptide sequence
KHRLGVENPHK

SEQ ID NO: 4560 - protein, 11 aa, Artificial
  IGFBP-2 heparin binding domain-containing peptide sequence
RHRLGVENPHK

SEQ ID NO: 4561 - protein, 11 aa, Artificial
  IGFBP-2 heparin binding domain-containing peptide sequence
HHRLGVENPHK

SEQ ID NO: 4562 - protein, 11 aa, Artificial
  IGFBP-2 heparin binding domain-containing peptide sequence
KKRLGVENPHK

SEQ ID NO: 4563 - protein, 11 aa, Artificial
  IGFBP-2 heparin binding domain-containing peptide sequence
RKRLGVENPHK

SEQ ID NO: 4564 - protein, 11 aa, Artificial
  IGFBP-2 heparin binding domain-containing peptide sequence
HKRLGVENPHK

SEQ ID NO: 4565 - protein, 11 aa, Artificial
  IGFBP-2 heparin binding domain-containing peptide sequence
KRRLGVENPHK

SEQ ID NO: 4566 - protein, 11 aa, Artificial
  IGFBP-2 heparin binding domain-containing peptide sequence
RRRLGVENPHK

SEQ ID NO: 4567 - protein, 11 aa, Artificial
  IGFBP-2 heparin binding domain-containing peptide sequence
HRRLGVENPHK

SEQ ID NO: 4568 - protein, 11 aa, Artificial
  IGFBP-2 heparin binding domain-containing peptide sequence
KHHIGVENPHK

SEQ ID NO: 4569 - protein, 11 aa, Artificial
  IGFBP-2 heparin binding domain-containing peptide sequence
RHHIGVEEPHK

SEQ ID NO: 4570 - protein, 11 aa, Artificial
  IGFBP-2 heparin binding domain-containing peptide sequence
HHHIGVENPHK

SEQ ID NO: 4571 - protein, 11 aa, Artificial
  IGFBP-2 heparin binding domain-containing peptide sequence
KKHIGVENPHK

SEQ ID NO: 4572 - protein, 11 aa, Artificial
  IGFBP-2 heparin binding domain-containing peptide sequence
RKHIGVENPHK

SEQ ID NO: 4573 - protein, 11 aa, Artificial
  IGFBP-2 heparin binding domain-containing peptide sequence
HKHIGVENPHK

SEQ ID NO: 4574 - protein, 11 aa, Artificial
  IGFBP-2 heparin binding domain-containing peptide sequence
KRHIGVENPHK

SEQ ID NO: 4575 - protein, 11 aa, Artificial
  IGFBP-2 heparin binding domain-containing peptide sequence
RRHIGVENPHK

SEQ ID NO: 4576 - protein, 11 aa, Artificial
  IGFBP-2 heparin binding domain-containing peptide sequence
HRHIGVENPHK

SEQ ID NO: 4577 - protein, 11 aa, Artificial
  IGFBP-2 heparin binding domain-containing peptide sequence
KHKIGVENPHK

SEQ ID NO: 4578 - protein, 11 aa, Artificial
  IGFBP-2 heparin binding domain-containing peptide sequence
RHKIGVENPHK

SEQ ID NO: 4579 - protein, 11 aa, Artificial
  IGFBP-2 heparin binding domain-containing peptide sequence
HHKIGVENPHK

SEQ ID NO: 4580 - protein, 11 aa, Artificial
  IGFBP-2 heparin binding domain-containing peptide sequence
KKKIGVENPHK

SEQ ID NO: 4581 - protein, 11 aa, Artificial
  IGFBP-2 heparin binding domain-containing peptide sequence
RKKIGVENPHK

SEQ ID NO: 4582 - protein, 11 aa, Artificial
  IGFBP-2 heparin binding domain-containing peptide sequence
HKKIGVENPHK

SEQ ID NO: 4583 - protein, 11 aa, Artificial
  IGFBP-2 heparin binding domain-containing peptide sequence
KRKIGVENPHK

SEQ ID NO: 4584 - protein, 11 aa, Artificial
  IGFBP-2 heparin binding domain-containing peptide sequence
RRKIGVENPHK

SEQ ID NO: 4585 - protein, 11 aa, Artificial
  IGFBP-2 heparin binding domain-containing peptide sequence
HRKIGVENPHK

SEQ ID NO: 4586 - protein, 11 aa, Artificial
  IGFBP-2 heparin binding domain-containing peptide sequence
KHRIGVENPHK

SEQ ID NO: 4587 - protein, 11 aa, Artificial
  IGFBP-2 heparin binding domain-containing peptide sequence
RHRIGVENPHK

SEQ ID NO: 4588 - protein, 11 aa, Artificial
  IGFBP-2 heparin binding domain-containing peptide sequence
HHRIGVENPHK

SEQ ID NO: 4589 - protein, 11 aa, Artificial
  IGFBP-2 heparin binding domain-containing peptide sequence
KKRIGVENPHK

SEQ ID NO: 4590 - protein, 11 aa, Artificial
  IGFBP-2 heparin binding domain-containing peptide sequence
RKRIGVENPHK

SEQ ID NO: 4591 - protein, 11 aa, Artificial
  IGFBP-2 heparin binding domain-containing peptide sequence
HKRIGVENPHK

SEQ ID NO: 4592 - protein, 11 aa, Artificial
  IGFBP-2 heparin binding domain-containing peptide sequence
KRRIGVENPHK

SEQ ID NO: 4593 - protein, 11 aa, Artificial
  IGFBP-2 heparin binding domain-containing peptide sequence
RRRIGVENPHK

SEQ ID NO: 4594 - protein, 11 aa, Artificial
  IGFBP-2 heparin binding domain-containing peptide sequence
HRRIGVENPHK

SEQ ID NO: 4595 - protein, 11 aa, Artificial
  IGFBP-2 heparin binding domain-containing peptide sequence
KHHVGVENPHK

SEQ ID NO: 4596 - protein, 11 aa, Artificial
  IGFBP-2 heparin binding domain-containing peptide sequence
RHHVGVENPHK

SEQ ID NO: 4597 - protein, 11 aa, Artificial
  IGFBP-2 heparin binding domain-containing peptide sequence
HHHVGVENPHK

SEQ ID NO: 4598 - protein, 11 aa, Artificial
  IGFBP-2 heparin binding domain-containing peptide sequence
KKHVGVENPHK

SEQ ID NO: 4599 - protein, 11 aa, Artificial
  IGFBP-2 heparin binding domain-containing peptide sequence
RKHVGVENPHK

SEQ ID NO: 4600 - protein, 11 aa, Artificial
  IGFBP-2 heparin binding domain-containing peptide sequence
HKHVGVENPHK

SEQ ID NO: 4601 - protein, 11 aa, Artificial
  IGFBP-2 heparin binding domain-containing peptide sequence
KRHVGVENPHK

SEQ ID NO: 4602 - protein, 11 aa, Artificial
  IGFBP-2 heparin binding domain-containing peptide sequence
RRHVGVENPHK

SEQ ID NO: 4603 - protein, 11 aa, Artificial
  IGFBP-2 heparin binding domain-containing peptide sequence
HRHVGVENPHK

SEQ ID NO: 4604 - protein, 11 aa, Artificial
  IGFBP-2 heparin binding domain-containing peptide sequence
KHKVGVENPHK

SEQ ID NO: 4605 - protein, 11 aa, Artificial
  IGFBP-2 heparin binding domain-containing peptide sequence
RHKVGVENPHK

SEQ ID NO: 4606 - protein, 11 aa, Artificial
  IGFBP-2 heparin binding domain-containing peptide sequence
HHKVGVENPHK

SEQ ID NO: 4607 - protein, 11 aa, Artificial
  IGFBP-2 heparin binding domain-containing peptide sequence
KKKVGVENPHK

SEQ ID NO: 4608 - protein, 11 aa, Artificial
  IGFBP-2 heparin binding domain-containing peptide sequence
RKKVGVENPHK

SEQ ID NO: 4609 - protein, 11 aa, Artificial
  IGFBP-2 heparin binding domain-containing peptide sequence
HKKVGVENPHK

SEQ ID NO: 4610 - protein, 11 aa, Artificial
  IGFBP-2 heparin binding domain-containing peptide sequence
KRKVGVENPHK

SEQ ID NO: 4611 - protein, 11 aa, Artificial
  IGFBP-2 heparin binding domain-containing peptide sequence
RRKVGVEEPHK

SEQ ID NO: 4612 - protein, 11 aa, Artificial
  IGFBP-2 heparin binding domain-containing peptide sequence
HRKVGVENPHK

SEQ ID NO: 4613 - protein, 11 aa, Artificial
  IGFBP-2 heparin binding domain-containing peptide sequence
KHRVGVENPHK

SEQ ID NO: 4614 - protein, 11 aa, Artificial
  IGFBP-2 heparin binding domain-containing peptide sequence
RHRVGVENPHK

SEQ ID NO: 4615 - protein, 11 aa, Artificial
  IGFBP-2 heparin binding domain-containing peptide sequence
HHRVGVENPHK

SEQ ID NO: 4616 - protein, 11 aa, Artificial
  IGFBP-2 heparin binding domain-containing peptide sequence
KKRVGVENPHK

SEQ ID NO: 4617 - protein, 11 aa, Artificial
  IGFBP-2 heparin binding domain-containing peptide sequence
RKRVGVENPHK

SEQ ID NO: 4618 - protein, 11 aa, Artificial
  IGFBP-2 heparin binding domain-containing peptide sequence
HKRVGVENPHK

SEQ ID NO: 4619 - protein, 11 aa, Artificial
  IGFBP-2 heparin binding domain-containing peptide sequence
KRRVGVENPHK

SEQ ID NO: 4620 - protein, 11 aa, Artificial
  IGFBP-2 heparin binding domain-containing peptide sequence
RRRVGVENPHK

SEQ ID NO: 4621 - protein, 11 aa, Artificial
  IGFBP-2 heparin binding domain-containing peptide sequence
HRRVGVENPHK

SEQ ID NO: 4622 - protein, 11 aa, Artificial
  IGFBP-2 heparin binding domain-containing peptide sequence
KHHLGLNNPHK

SEQ ID NO: 4623 - protein, 11 aa, Artificial
  IGFBP-2 heparin binding domain-containing peptide sequence
RHHLGLNNPHK

SEQ ID NO: 4624 - protein, 11 aa, Artificial
  IGFBP-2 heparin binding domain-containing peptide sequence
HHHLGLNNPHK

SEQ ID NO: 4625 - protein, 11 aa, Artificial
  IGFBP-2 heparin binding domain-containing peptide sequence
KKHLGLNNPHK

SEQ ID NO: 4626 - protein, 11 aa, Artificial
  IGFBP-2 heparin binding domain-containing peptide sequence
RKHLGLNNPHK

SEQ ID NO: 4627 - protein, 11 aa, Artificial
  IGFBP-2 heparin binding domain-containing peptide sequence
HKHLGLNNPHK

SEQ ID NO: 4628 - protein, 11 aa, Artificial
  IGFBP-2 heparin binding domain-containing peptide sequence
KRHLGLNNPHK

SEQ ID NO: 4629 - protein, 11 aa, Artificial
  IGFBP-2 heparin binding domain-containing peptide sequence
RRHLGLNNPHK

SEQ ID NO: 4630 - protein, 11 aa, Artificial
  IGFBP-2 heparin binding domain-containing peptide sequence
HRHLGLNNPHK

SEQ ID NO: 4631 - protein, 11 aa, Artificial
  IGFBP-2 heparin binding domain-containing peptide sequence
KHKLGLNNPHK

SEQ ID NO: 4632 - protein, 11 aa, Artificial
  IGFBP-2 heparin binding domain-containing peptide sequence
RHKLGLNNPHK

SEQ ID NO: 4633 - protein, 11 aa, Artificial
  IGFBP-2 heparin binding domain-containing peptide sequence
HHKLGLNNPHK

SEQ ID NO: 4634 - protein, 11 aa, Artificial
  IGFBP-2 heparin binding domain-containing peptide sequence
KKKLGLNNPHK

SEQ ID NO: 4635 - protein, 11 aa, Artificial
  IGFBP-2 heparin binding domain-containing peptide sequence
RKKLGLNNPHK

SEQ ID NO: 4636 - protein, 11 aa, Artificial
  IGFBP-2 heparin binding domain-containing peptide sequence
HKKLGLNNPHK

SEQ ID NO: 4637 - protein, 11 aa, Artificial
  IGFBP-2 heparin binding domain-containing peptide sequence
KRKLGLNNPHK

SEQ ID NO: 4638 - protein, 11 aa, Artificial
  IGFBP-2 heparin binding domain-containing peptide sequence
RRKLGLNNPHK

SEQ ID NO: 4639 - protein, 11 aa, Artificial
  IGFBP-2 heparin binding domain-containing peptide sequence
HRKLGLNNPHK

SEQ ID NO: 4640 - protein, 11 aa, Artificial
  IGFBP-2 heparin binding domain-containing peptide sequence
KHRLGLNNPHK

SEQ ID NO: 4641 - protein, 11 aa, Artificial
  IGFBP-2 heparin binding domain-containing peptide sequence
RHRLGLNNPHK

SEQ ID NO: 4642 - protein, 11 aa, Artificial
  IGFBP-2 heparin binding domain-containing peptide sequence
HHRLGLNNPHK

SEQ ID NO: 4643 - protein, 11 aa, Artificial
  IGFBP-2 heparin binding domain-containing peptide sequence
KKRLGLNNPHK

SEQ ID NO: 4644 - protein, 11 aa, Artificial
  IGFBP-2 heparin binding domain-containing peptide sequence
RKRLGLNNPHK

SEQ ID NO: 4645 - protein, 11 aa, Artificial
  IGFBP-2 heparin binding domain-containing peptide sequence
HKRLGLNNPHK

SEQ ID NO: 4646 - protein, 11 aa, Artificial
  IGFBP-2 heparin binding domain-containing peptide sequence
KRRLGLNNPHK

SEQ ID NO: 4647 - protein, 11 aa, Artificial
  IGFBP-2 heparin binding domain-containing peptide sequence
RRRLGLNNPHK

SEQ ID NO: 4648 - protein, 11 aa, Artificial
  IGFBP-2 heparin binding domain-containing peptide sequence
HRRLGLNNPHK

SEQ ID NO: 4649 - protein, 11 aa, Artificial
  IGFBP-2 heparin binding domain-containing peptide sequence
KHHIGLNNPHK

SEQ ID NO: 4650 - protein, 11 aa, Artificial
  IGFBP-2 heparin binding domain-containing peptide sequence
RHHIGLNNPHK

SEQ ID NO: 4651 - protein, 11 aa, Artificial
  IGFBP-2 heparin binding domain-containing peptide sequence
HHHIGLNNPHK

SEQ ID NO: 4652 - protein, 11 aa, Artificial
  IGFBP-2 heparin binding domain-containing peptide sequence
KKHIGLNNPHK

SEQ ID NO: 4653 - protein, 11 aa, Artificial
  IGFBP-2 heparin binding domain-containing peptide sequence
RKHIGLNNPHK

SEQ ID NO: 4654 - protein, 11 aa, Artificial
  IGFBP-2 heparin binding domain-containing peptide sequence
HKHIGLNNPHK

SEQ ID NO: 4655 - protein, 11 aa, Artificial
  IGFBP-2 heparin binding domain-containing peptide sequence
KRHIGLNNPHK

SEQ ID NO: 4656 - protein, 11 aa, Artificial
  IGFBP-2 heparin binding domain-containing peptide sequence
RRHIGLNNPHK

SEQ ID NO: 4657 - protein, 11 aa, Artificial
  IGFBP-2 heparin binding domain-containing peptide sequence
HRHIGLNNPHK

SEQ ID NO: 4658 - protein, 11 aa, Artificial
  IGFBP-2 heparin binding domain-containing peptide sequence
KHKIGLNNPHK

SEQ ID NO: 4659 - protein, 11 aa, Artificial
  IGFBP-2 heparin binding domain-containing peptide sequence
RHKIGLNNPHK

SEQ ID NO: 4660 - protein, 11 aa, Artificial
  IGFBP-2 heparin binding domain-containing peptide sequence
HHKIGLNNPHK

SEQ ID NO: 4661 - protein, 11 aa, Artificial
  IGFBP-2 heparin binding domain-containing peptide sequence
KKKIGLNNPHK

SEQ ID NO: 4662 - protein, 11 aa, Artificial
  IGFBP-2 heparin binding domain-containing peptide sequence
RKKIGLNNPHK

SEQ ID NO: 4663 - protein, 11 aa, Artificial
  IGFBP-2 heparin binding domain-containing peptide sequence
HKKIGLNNPHK

SEQ ID NO: 4664 - protein, 11 aa, Artificial
  IGFBP-2 heparin binding domain-containing peptide sequence
KRKIGLNNPHK

SEQ ID NO: 4665 - protein, 11 aa, Artificial
  IGFBP-2 heparin binding domain-containing peptide sequence
RRKIGLNNPHK

SEQ ID NO: 4666 - protein, 11 aa, Artificial
  IGFBP-2 heparin binding domain-containing peptide sequence
HRKIGLNNPHK

SEQ ID NO: 4667 - protein, 11 aa, Artificial
  IGFBP-2 heparin binding domain-containing peptide sequence
KHRIGLNNPHK

SEQ ID NO: 4668 - protein, 11 aa, Artificial
  IGFBP-2 heparin binding domain-containing peptide sequence
RHRIGLNNPHK

SEQ ID NO: 4669 - protein, 11 aa, Artificial
  IGFBP-2 heparin binding domain-containing peptide sequence
HHRIGLNNPHK

SEQ ID NO: 4670 - protein, 11 aa, Artificial
  IGFBP-2 heparin binding domain-containing peptide sequence
KKRIGLNNPHK

SEQ ID NO: 4671 - protein, 11 aa, Artificial
  IGFBP-2 heparin binding domain-containing peptide sequence
RKRIGLNNPHK

SEQ ID NO: 4672 - protein, 11 aa, Artificial
  IGFBP-2 heparin binding domain-containing peptide sequence
HKRIGLNNPHK

SEQ ID NO: 4673 - protein, 11 aa, Artificial
  IGFBP-2 heparin binding domain-containing peptide sequence
KRRIGLNNPHK

SEQ ID NO: 4674 - protein, 11 aa, Artificial
  IGFBP-2 heparin binding domain-containing peptide sequence
RRRIGLNNPHK

SEQ ID NO: 4675 - protein, 11 aa, Artificial
  IGFBP-2 heparin binding domain-containing peptide sequence
HRRIGLNNPHK

SEQ ID NO: 4676 - protein, 11 aa, Artificial
  IGFBP-2 heparin binding domain-containing peptide sequence
KHHVGLNNPHK

SEQ ID NO: 4677 - protein, 11 aa, Artificial
  IGFBP-2 heparin binding domain-containing peptide sequence
RHHVGLNNPHK

SEQ ID NO: 4678 - protein, 11 aa, Artificial
  IGFBP-2 heparin binding domain-containing peptide sequence
HHHVGLNNPHK

SEQ ID NO: 4679 - protein, 11 aa, Artificial
  IGFBP-2 heparin binding domain-containing peptide sequence
KKHVGLNNPHK

SEQ ID NO: 4680 - protein, 11 aa, Artificial
  IGFBP-2 heparin binding domain-containing peptide sequence
RKHVGLNNPHK

SEQ ID NO: 4681 - protein, 11 aa, Artificial
  IGFBP-2 heparin binding domain-containing peptide sequence
HKHVGLNNPHK

SEQ ID NO: 4682 - protein, 11 aa, Artificial
  IGFBP-2 heparin binding domain-containing peptide sequence
KRHVGLNNPHK

SEQ ID NO: 4683 - protein, 11 aa, Artificial
  IGFBP-2 heparin binding domain-containing peptide sequence
RRHVGLNNPHK

SEQ ID NO: 4684 - protein, 11 aa, Artificial
  IGFBP-2 heparin binding domain-containing peptide sequence
HRHVGLNNPHK

SEQ ID NO: 4685 - protein, 11 aa, Artificial
  IGFBP-2 heparin binding domain-containing peptide sequence
KHKVGLNNPHK

SEQ ID NO: 4686 - protein, 11 aa, Artificial
  IGFBP-2 heparin binding domain-containing peptide sequence
RHKVGLNNPHK

SEQ ID NO: 4687 - protein, 11 aa, Artificial
  IGFBP-2 heparin binding domain-containing peptide sequence
HHKVGLNNPHK

SEQ ID NO: 4688 - protein, 11 aa, Artificial
  IGFBP-2 heparin binding domain-containing peptide sequence
KKKVGLNNPHK

SEQ ID NO: 4689 - protein, 11 aa, Artificial
  IGFBP-2 heparin binding domain-containing peptide sequence
RKKVGLNNPHK

SEQ ID NO: 4690 - protein, 11 aa, Artificial
  IGFBP-2 heparin binding domain-containing peptide sequence
HKKVGLNNPHK

SEQ ID NO: 4691 - protein, 11 aa, Artificial
  IGFBP-2 heparin binding domain-containing peptide sequence
KRKVGLNNPHK

SEQ ID NO: 4692 - protein, 11 aa, Artificial
  IGFBP-2 heparin binding domain-containing peptide sequence
RRKVGLNNPHK

SEQ ID NO: 4693 - protein, 11 aa, Artificial
  IGFBP-2 heparin binding domain-containing peptide sequence
HRKVGLNNPHK

SEQ ID NO: 4694 - protein, 11 aa, Artificial
  IGFBP-2 heparin binding domain-containing peptide sequence
KHRVGLNNPHK

SEQ ID NO: 4695 - protein, 11 aa, Artificial
  IGFBP-2 heparin binding domain-containing peptide sequence
RHRVGLNNPHK

SEQ ID NO: 4696 - protein, 11 aa, Artificial
  IGFBP-2 heparin binding domain-containing peptide sequence
HHRVGLNNPHK

SEQ ID NO: 4697 - protein, 11 aa, Artificial
  IGFBP-2 heparin binding domain-containing peptide sequence
KKRVGLNNPHK

SEQ ID NO: 4698 - protein, 11 aa, Artificial
  IGFBP-2 heparin binding domain-containing peptide sequence
RKRVGLNNPHK

SEQ ID NO: 4699 - protein, 11 aa, Artificial
  IGFBP-2 heparin binding domain-containing peptide sequence
HKRVGLNNPHK

SEQ ID NO: 4700 - protein, 11 aa, Artificial
  IGFBP-2 heparin binding domain-containing peptide sequence
KRRVGLNNPHK

SEQ ID NO: 4701 - protein, 11 aa, Artificial
  IGFBP-2 heparin binding domain-containing peptide sequence
RRRVGLNNPHK

SEQ ID NO: 4702 - protein, 11 aa, Artificial
  IGFBP-2 heparin binding domain-containing peptide sequence
HRRVGLNNPHK

SEQ ID NO: 4703 - protein, 11 aa, Artificial
  IGFBP-2 heparin binding domain-containing peptide sequence
KHHLGINNPHK

SEQ ID NO: 4704 - protein, 11 aa, Artificial
  IGFBP-2 heparin binding domain-containing peptide sequence
RHHLGINNPHK

SEQ ID NO: 4705 - protein, 11 aa, Artificial
  IGFBP-2 heparin binding domain-containing peptide sequence
HHHLGINNPHK

SEQ ID NO: 4706 - protein, 11 aa, Artificial
  IGFBP-2 heparin binding domain-containing peptide sequence
KKHLGINNPHK

SEQ ID NO: 4707 - protein, 11 aa, Artificial
  IGFBP-2 heparin binding domain-containing peptide sequence
RKHLGINNPHK

SEQ ID NO: 4708 - protein, 11 aa, Artificial
  IGFBP-2 heparin binding domain-containing peptide sequence
HKHLGINNPHK

SEQ ID NO: 4709 - protein, 11 aa, Artificial
  IGFBP-2 heparin binding domain-containing peptide sequence
KRHLGINNPHK

SEQ ID NO: 4710 - protein, 11 aa, Artificial
  IGFBP-2 heparin binding domain-containing peptide sequence
RRHLGINNPHK

SEQ ID NO: 4711 - protein, 11 aa, Artificial
  IGFBP-2 heparin binding domain-containing peptide sequence
HRHLGINNPHK

SEQ ID NO: 4712 - protein, 11 aa, Artificial
  IGFBP-2 heparin binding domain-containing peptide sequence
KHKLGINNPHK

SEQ ID NO: 4713 - protein, 11 aa, Artificial
  IGFBP-2 heparin binding domain-containing peptide sequence
RHKLGINNPHK

SEQ ID NO: 4714 - protein, 11 aa, Artificial
  IGFBP-2 heparin binding domain-containing peptide sequence
HHKLGINNPHK

SEQ ID NO: 4715 - protein, 11 aa, Artificial
  IGFBP-2 heparin binding domain-containing peptide sequence
KKKLGINNPHK

SEQ ID NO: 4716 - protein, 11 aa, Artificial
  IGFBP-2 heparin binding domain-containing peptide sequence
RKKLGINNPHK

SEQ ID NO: 4717 - protein, 11 aa, Artificial
  IGFBP-2 heparin binding domain-containing peptide sequence
HKKLGINNPHK

SEQ ID NO: 4718 - protein, 11 aa, Artificial
  IGFBP-2 heparin binding domain-containing peptide sequence
KRKLGINNPHK

SEQ ID NO: 4719 - protein, 11 aa, Artificial
  IGFBP-2 heparin binding domain-containing peptide sequence
RRKLGINNPHK

SEQ ID NO: 4720 - protein, 11 aa, Artificial
  IGFBP-2 heparin binding domain-containing peptide sequence
HRKLGINNPHK

SEQ ID NO: 4721 - protein, 11 aa, Artificial
  IGFBP-2 heparin binding domain-containing peptide sequence
KHRLGINNPHK

SEQ ID NO: 4722 - protein, 11 aa, Artificial
  IGFBP-2 heparin binding domain-containing peptide sequence
RHRLGINNPHK

SEQ ID NO: 4723 - protein, 11 aa, Artificial
  IGFBP-2 heparin binding domain-containing peptide sequence
HHRLGINNPHK

SEQ ID NO: 4724 - protein, 11 aa, Artificial
  IGFBP-2 heparin binding domain-containing peptide sequence
KKRLGINNPHK

SEQ ID NO: 4725 - protein, 11 aa, Artificial
  IGFBP-2 heparin binding domain-containing peptide sequence
RKRLGINNPHK

SEQ ID NO: 4726 - protein, 11 aa, Artificial
  IGFBP-2 heparin binding domain-containing peptide sequence
HKRLGINNPHK

SEQ ID NO: 4727 - protein, 11 aa, Artificial
  IGFBP-2 heparin binding domain-containing peptide sequence
KRRLGINNPHK

SEQ ID NO: 4728 - protein, 11 aa, Artificial
  IGFBP-2 heparin binding domain-containing peptide sequence
RRRLGINNPHK

SEQ ID NO: 4729 - protein, 11 aa, Artificial
  IGFBP-2 heparin binding domain-containing peptide sequence
HRRLGINNPHK

SEQ ID NO: 4730 - protein, 11 aa, Artificial
  IGFBP-2 heparin binding domain-containing peptide sequence
KHHIGIENPHK

SEQ ID NO: 4731 - protein, 11 aa, Artificial
  IGFBP-2 heparin binding domain-containing peptide sequence
RHHIGINNPHK

SEQ ID NO: 4732 - protein, 11 aa, Artificial
  IGFBP-2 heparin binding domain-containing peptide sequence
HHHIGINNPHK

SEQ ID NO: 4733 - protein, 11 aa, Artificial
  IGFBP-2 heparin binding domain-containing peptide sequence
KKHIGINNPHK

SEQ ID NO: 4734 - protein, 11 aa, Artificial
  IGFBP-2 heparin binding domain-containing peptide sequence
RKHIGINNPHK

SEQ ID NO: 4735 - protein, 11 aa, Artificial
  IGFBP-2 heparin binding domain-containing peptide sequence
HKHIGINNPHK

SEQ ID NO: 4736 - protein, 11 aa, Artificial
  IGFBP-2 heparin binding domain-containing peptide sequence
KRHIGINNPHK

SEQ ID NO: 4737 - protein, 11 aa, Artificial
  IGFBP-2 heparin binding domain-containing peptide sequence
RRHIGINNPHK

SEQ ID NO: 4738 - protein, 11 aa, Artificial
  IGFBP-2 heparin binding domain-containing peptide sequence
HRHIGINNPHK

SEQ ID NO: 4739 - protein, 11 aa, Artificial
  IGFBP-2 heparin binding domain-containing peptide sequence
KHKIGINNPHK

SEQ ID NO: 4740 - protein, 11 aa, Artificial
  IGFBP-2 heparin binding domain-containing peptide sequence
RHKIGINNPHK

SEQ ID NO: 4741 - protein, 11 aa, Artificial
  IGFBP-2 heparin binding domain-containing peptide sequence
HHKIGINNPHK

SEQ ID NO: 4742 - protein, 11 aa, Artificial
  IGFBP-2 heparin binding domain-containing peptide sequence
KKKIGINNPHK

SEQ ID NO: 4743 - protein, 11 aa, Artificial
  IGFBP-2 heparin binding domain-containing peptide sequence
RKKIGINNPHK

SEQ ID NO: 4744 - protein, 11 aa, Artificial
  IGFBP-2 heparin binding domain-containing peptide sequence
HKKIGINNPHK

SEQ ID NO: 4745 - protein, 11 aa, Artificial
  IGFBP-2 heparin binding domain-containing peptide sequence
KRKIGINNPHK

SEQ ID NO: 4746 - protein, 11 aa, Artificial
  IGFBP-2 heparin binding domain-containing peptide sequence
RRKIGINNPHK

SEQ ID NO: 4747 - protein, 11 aa, Artificial
  IGFBP-2 heparin binding domain-containing peptide sequence
HRKIGINNPHK

SEQ ID NO: 4748 - protein, 11 aa, Artificial
  IGFBP-2 heparin binding domain-containing peptide sequence
KHRIGINNPHK

SEQ ID NO: 4749 - protein, 11 aa, Artificial
  IGFBP-2 heparin binding domain-containing peptide sequence
RHRIGINNPHK

SEQ ID NO: 4750 - protein, 11 aa, Artificial
  IGFBP-2 heparin binding domain-containing peptide sequence
HHRIGINNPHK

SEQ ID NO: 4751 - protein, 11 aa, Artificial
  IGFBP-2 heparin binding domain-containing peptide sequence
KKRIGINNPHK

SEQ ID NO: 4752 - protein, 11 aa, Artificial
  IGFBP-2 heparin binding domain-containing peptide sequence
RKRIGINNPHK

SEQ ID NO: 4753 - protein, 11 aa, Artificial
  IGFBP-2 heparin binding domain-containing peptide sequence
HKRIGINNPHK

SEQ ID NO: 4754 - protein, 11 aa, Artificial
  IGFBP-2 heparin binding domain-containing peptide sequence
KRRIGINNPHK

SEQ ID NO: 4755 - protein, 11 aa, Artificial
  IGFBP-2 heparin binding domain-containing peptide sequence
RRRIGINNPHK

SEQ ID NO: 4756 - protein, 11 aa, Artificial
  IGFBP-2 heparin binding domain-containing peptide sequence
HRRIGINNPHK

SEQ ID NO: 4757 - protein, 11 aa, Artificial
  IGFBP-2 heparin binding domain-containing peptide sequence
KHHVGINNPHK

SEQ ID NO: 4758 - protein, 11 aa, Artificial
  IGFBP-2 heparin binding domain-containing peptide sequence
RHHVGINNPHK

SEQ ID NO: 4759 - protein, 11 aa, Artificial
  IGFBP-2 heparin binding domain-containing peptide sequence
HHHVGINNPHK

SEQ ID NO: 4760 - protein, 11 aa, Artificial
  IGFBP-2 heparin binding domain-containing peptide sequence
KKHVGINNPHK

SEQ ID NO: 4761 - protein, 11 aa, Artificial
  IGFBP-2 heparin binding domain-containing peptide sequence
RKHVGINNPHK

SEQ ID NO: 4762 - protein, 11 aa, Artificial
  IGFBP-2 heparin binding domain-containing peptide sequence
HKHVGINNPHK

SEQ ID NO: 4763 - protein, 11 aa, Artificial
  IGFBP-2 heparin binding domain-containing peptide sequence
KRHVGINNPHK

SEQ ID NO: 4764 - protein, 11 aa, Artificial
  IGFBP-2 heparin binding domain-containing peptide sequence
RRHVGINNPHK

SEQ ID NO: 4765 - protein, 11 aa, Artificial
  IGFBP-2 heparin binding domain-containing peptide sequence
HRHVGINNPHK

SEQ ID NO: 4766 - protein, 11 aa, Artificial
  IGFBP-2 heparin binding domain-containing peptide sequence
KHKVGINNPHK

SEQ ID NO: 4767 - protein, 11 aa, Artificial
  IGFBP-2 heparin binding domain-containing peptide sequence
RHKVGINNPHK

SEQ ID NO: 4768 - protein, 11 aa, Artificial
  IGFBP-2 heparin binding domain-containing peptide sequence
HHKVGINNPHK

SEQ ID NO: 4769 - protein, 11 aa, Artificial
  IGFBP-2 heparin binding domain-containing peptide sequence
KKKVGINNPHK

SEQ ID NO: 4770 - protein, 11 aa, Artificial
  IGFBP-2 heparin binding domain-containing peptide sequence
RKKVGINNPHK

SEQ ID NO: 4771 - protein, 11 aa, Artificial
  IGFBP-2 heparin binding domain-containing peptide sequence
HKKVGINNPHK

SEQ ID NO: 4772 - protein, 11 aa, Artificial
  IGFBP-2 heparin binding domain-containing peptide sequence
KRKVGINNPHK

SEQ ID NO: 4773 - protein, 11 aa, Artificial
  IGFBP-2 heparin binding domain-containing peptide sequence
RRKVGINNPHK

SEQ ID NO: 4774 - protein, 11 aa, Artificial
  IGFBP-2 heparin binding domain-containing peptide sequence
HRKVGINNPHK

SEQ ID NO: 4775 - protein, 11 aa, Artificial
  IGFBP-2 heparin binding domain-containing peptide sequence
KHRVGINNPHK

SEQ ID NO: 4776 - protein, 11 aa, Artificial
  IGFBP-2 heparin binding domain-containing peptide sequence
RHRVGINNPHK

SEQ ID NO: 4777 - protein, 11 aa, Artificial
  IGFBP-2 heparin binding domain-containing peptide sequence
HHRVGINNPHK

SEQ ID NO: 4778 - protein, 11 aa, Artificial
  IGFBP-2 heparin binding domain-containing peptide sequence
KKRVGINNPHK

SEQ ID NO: 4779 - protein, 11 aa, Artificial
  IGFBP-2 heparin binding domain-containing peptide sequence
RKRVGINNPHK

SEQ ID NO: 4780 - protein, 11 aa, Artificial
  IGFBP-2 heparin binding domain-containing peptide sequence
HKRVGINNPHK

SEQ ID NO: 4781 - protein, 11 aa, Artificial
  IGFBP-2 heparin binding domain-containing peptide sequence
KRRVGINNPHK

SEQ ID NO: 4782 - protein, 11 aa, Artificial
  IGFBP-2 heparin binding domain-containing peptide sequence
RRRVGINNPHK

SEQ ID NO: 4783 - protein, 11 aa, Artificial
  IGFBP-2 heparin binding domain-containing peptide sequence
HRRVGINNPHK

SEQ ID NO: 4784 - protein, 11 aa, Artificial
  IGFBP-2 heparin binding domain-containing peptide sequence
KHHLGVNNPHK

SEQ ID NO: 4785 - protein, 11 aa, Artificial
  IGFBP-2 heparin binding domain-containing peptide sequence
RHHLGVNNPHK

SEQ ID NO: 4786 - protein, 11 aa, Artificial
  IGFBP-2 heparin binding domain-containing peptide sequence
HHHLGVNNPHK

SEQ ID NO: 4787 - protein, 11 aa, Artificial
  IGFBP-2 heparin binding domain-containing peptide sequence
KKHLGVNNPHK

SEQ ID NO: 4788 - protein, 11 aa, Artificial
  IGFBP-2 heparin binding domain-containing peptide sequence
RKHLGVNNPHK

SEQ ID NO: 4789 - protein, 11 aa, Artificial
  IGFBP-2 heparin binding domain-containing peptide sequence
HKHLGVNNPHK

SEQ ID NO: 4790 - protein, 11 aa, Artificial
  IGFBP-2 heparin binding domain-containing peptide sequence
KRHLGVNNPHK

SEQ ID NO: 4791 - protein, 11 aa, Artificial
  IGFBP-2 heparin binding domain-containing peptide sequence
RRHLGVNNPHK

SEQ ID NO: 4792 - protein, 11 aa, Artificial
  IGFBP-2 heparin binding domain-containing peptide sequence
HRHLGVNNPHK

SEQ ID NO: 4793 - protein, 11 aa, Artificial
  IGFBP-2 heparin binding domain-containing peptide sequence
KHKLGVNNPHK

SEQ ID NO: 4794 - protein, 11 aa, Artificial
  IGFBP-2 heparin binding domain-containing peptide sequence
RHKLGVNNPHK

SEQ ID NO: 4795 - protein, 11 aa, Artificial
  IGFBP-2 heparin binding domain-containing peptide sequence
HHKLGVNNPHK

SEQ ID NO: 4796 - protein, 11 aa, Artificial
  IGFBP-2 heparin binding domain-containing peptide sequence
KKKLGVNNPHK

SEQ ID NO: 4797 - protein, 11 aa, Artificial
  IGFBP-2 heparin binding domain-containing peptide sequence
RKKLGVNNPHK

SEQ ID NO: 4798 - protein, 11 aa, Artificial
  IGFBP-2 heparin binding domain-containing peptide sequence
HKKLGVNNPHK

SEQ ID NO: 4799 - protein, 11 aa, Artificial
  IGFBP-2 heparin binding domain-containing peptide sequence
KRKLGVNNPHK

SEQ ID NO: 4800 - protein, 11 aa, Artificial
  IGFBP-2 heparin binding domain-containing peptide sequence
RRKLGVNNPHK

SEQ ID NO: 4801 - protein, 11 aa, Artificial
  IGFBP-2 heparin binding domain-containing peptide sequence
HRKLGVNNPHK

SEQ ID NO: 4802 - protein, 11 aa, Artificial
  IGFBP-2 heparin binding domain-containing peptide sequence
KHRLGVNNPHK

SEQ ID NO: 4803 - protein, 11 aa, Artificial
  IGFBP-2 heparin binding domain-containing peptide sequence
RHRLGVNNPHK

SEQ ID NO: 4804 - protein, 11 aa, Artificial
  IGFBP-2 heparin binding domain-containing peptide sequence
HHRLGVNNPHK

SEQ ID NO: 4805 - protein, 11 aa, Artificial
  IGFBP-2 heparin binding domain-containing peptide sequence
KKRLGVNNPHK

SEQ ID NO: 4806 - protein, 11 aa, Artificial
  IGFBP-2 heparin binding domain-containing peptide sequence
RKRLGVNNPHK

SEQ ID NO: 4807 - protein, 11 aa, Artificial
  IGFBP-2 heparin binding domain-containing peptide sequence
HKRLGVNNPHK

SEQ ID NO: 4808 - protein, 11 aa, Artificial
  IGFBP-2 heparin binding domain-containing peptide sequence
KRRLGVNNPHK

SEQ ID NO: 4809 - protein, 11 aa, Artificial
  IGFBP-2 heparin binding domain-containing peptide sequence
RRRLGVNNPHK

SEQ ID NO: 4810 - protein, 11 aa, Artificial
  IGFBP-2 heparin binding domain-containing peptide sequence
HRRLGVNNPHK

SEQ ID NO: 4811 - protein, 11 aa, Artificial
  IGFBP-2 heparin binding domain-containing peptide sequence
KHHIGVNNPHK

SEQ ID NO: 4812 - protein, 11 aa, Artificial
  IGFBP-2 heparin binding domain-containing peptide sequence
RHHIGVNNPHK

SEQ ID NO: 4813 - protein, 11 aa, Artificial
  IGFBP-2 heparin binding domain-containing peptide sequence
HHHIGVNNPHK

SEQ ID NO: 4814 - protein, 11 aa, Artificial
  IGFBP-2 heparin binding domain-containing peptide sequence
KKHIGVNNPHK

SEQ ID NO: 4815 - protein, 11 aa, Artificial
  IGFBP-2 heparin binding domain-containing peptide sequence
RKHIGVNNPHK

SEQ ID NO: 4816 - protein, 11 aa, Artificial
  IGFBP-2 heparin binding domain-containing peptide sequence
HKHIGVNNPHK

SEQ ID NO: 4817 - protein, 11 aa, Artificial
  IGFBP-2 heparin binding domain-containing peptide sequence
KRHIGVNNPHK

SEQ ID NO: 4818 - protein, 11 aa, Artificial
  IGFBP-2 heparin binding domain-containing peptide sequence
RRHIGVNNPHK

SEQ ID NO: 4819 - protein, 11 aa, Artificial
  IGFBP-2 heparin binding domain-containing peptide sequence
HRHIGVNNPHK

SEQ ID NO: 4820 - protein, 11 aa, Artificial
  IGFBP-2 heparin binding domain-containing peptide sequence
KHKIGVNNPHK

SEQ ID NO: 4821 - protein, 11 aa, Artificial
  IGFBP-2 heparin binding domain-containing peptide sequence
RHKIGVNNPHK

SEQ ID NO: 4822 - protein, 11 aa, Artificial
  IGFBP-2 heparin binding domain-containing peptide sequence
HHKIGVNNPHK

SEQ ID NO: 4823 - protein, 11 aa, Artificial
  IGFBP-2 heparin binding domain-containing peptide sequence
KKKIGVNNPHK

SEQ ID NO: 4824 - protein, 11 aa, Artificial
  IGFBP-2 heparin binding domain-containing peptide sequence
RKKIGVNNPHK

SEQ ID NO: 4825 - protein, 11 aa, Artificial
  IGFBP-2 heparin binding domain-containing peptide sequence
HKKIGVNNPHK

SEQ ID NO: 4826 - protein, 11 aa, Artificial
  IGFBP-2 heparin binding domain-containing peptide sequence
KRKIGVNNPHK

SEQ ID NO: 4827 - protein, 11 aa, Artificial
  IGFBP-2 heparin binding domain-containing peptide sequence
RRKIGVNNPHK

SEQ ID NO: 4828 - protein, 11 aa, Artificial
  IGFBP-2 heparin binding domain-containing peptide sequence
HRKIGVNNPHK

SEQ ID NO: 4829 - protein, 11 aa, Artificial
  IGFBP-2 heparin binding domain-containing peptide sequence
KHRIGVNNPHK

SEQ ID NO: 4830 - protein, 11 aa, Artificial
  IGFBP-2 heparin binding domain-containing peptide sequence
RHRIGVNNPHK

SEQ ID NO: 4831 - protein, 11 aa, Artificial
  IGFBP-2 heparin binding domain-containing peptide sequence
HHRIGVNNPHK

SEQ ID NO: 4832 - protein, 11 aa, Artificial
  IGFBP-2 heparin binding domain-containing peptide sequence
KKRIGVNNPHK

SEQ ID NO: 4833 - protein, 11 aa, Artificial
  IGFBP-2 heparin binding domain-containing peptide sequence
RKRIGVNNPHK

SEQ ID NO: 4834 - protein, 11 aa, Artificial
  IGFBP-2 heparin binding domain-containing peptide sequence
HKRIGVNNPHK

SEQ ID NO: 4835 - protein, 11 aa, Artificial
  IGFBP-2 heparin binding domain-containing peptide sequence
KRRIGVNNPHK

SEQ ID NO: 4836 - protein, 11 aa, Artificial
  IGFBP-2 heparin binding domain-containing peptide sequence
RRRIGVNNPHK

SEQ ID NO: 4837 - protein, 11 aa, Artificial
  IGFBP-2 heparin binding domain-containing peptide sequence
HRRIGVNNPHK

SEQ ID NO: 4838 - protein, 11 aa, Artificial
  IGFBP-2 heparin binding domain-containing peptide sequence
KHHVGVNNPHK

SEQ ID NO: 4839 - protein, 11 aa, Artificial
  IGFBP-2 heparin binding domain-containing peptide sequence
RHHVGVNNPHK

SEQ ID NO: 4840 - protein, 11 aa, Artificial
  IGFBP-2 heparin binding domain-containing peptide sequence
HHHVGVNNPHK

SEQ ID NO: 4841 - protein, 11 aa, Artificial
  IGFBP-2 heparin binding domain-containing peptide sequence
KKHVGVNNPHK

SEQ ID NO: 4842 - protein, 11 aa, Artificial
  IGFBP-2 heparin binding domain-containing peptide sequence
RKHVGVNNPHK

SEQ ID NO: 4843 - protein, 11 aa, Artificial
  IGFBP-2 heparin binding domain-containing peptide sequence
HKHVGVNNPHK

SEQ ID NO: 4844 - protein, 11 aa, Artificial
  IGFBP-2 heparin binding domain-containing peptide sequence
KRHVGVNNPHK

SEQ ID NO: 4845 - protein, 11 aa, Artificial
  IGFBP-2 heparin binding domain-containing peptide sequence
RRHVGVNNPHK

SEQ ID NO: 4846 - protein, 11 aa, Artificial
  IGFBP-2 heparin binding domain-containing peptide sequence
HRHVGVNNPHK

SEQ ID NO: 4847 - protein, 11 aa, Artificial
  IGFBP-2 heparin binding domain-containing peptide sequence
KHKVGVNNPHK

SEQ ID NO: 4848 - protein, 11 aa, Artificial
  IGFBP-2 heparin binding domain-containing peptide sequence
RHKVGVNNPHK

SEQ ID NO: 4849 - protein, 11 aa, Artificial
  IGFBP-2 heparin binding domain-containing peptide sequence
HHKVGVNNPHK

SEQ ID NO: 4850 - protein, 11 aa, Artificial
  IGFBP-2 heparin binding domain-containing peptide sequence
KKKVGVNNPHK

SEQ ID NO: 4851 - protein, 11 aa, Artificial
  IGFBP-2 heparin binding domain-containing peptide sequence
RKKVGVNNPHK

SEQ ID NO: 4852 - protein, 11 aa, Artificial
  IGFBP-2 heparin binding domain-containing peptide sequence
HKKVGVNNPHK

SEQ ID NO: 4853 - protein, 11 aa, Artificial
  IGFBP-2 heparin binding domain-containing peptide sequence
KRKVGVNNPHK

SEQ ID NO: 4854 - protein, 11 aa, Artificial
  IGFBP-2 heparin binding domain-containing peptide sequence
RRKVGVNNPHK

SEQ ID NO: 4855 - protein, 11 aa, Artificial
  IGFBP-2 heparin binding domain-containing peptide sequence
HRKVGVNNPHK

SEQ ID NO: 4856 - protein, 11 aa, Artificial
  IGFBP-2 heparin binding domain-containing peptide sequence
KHRVGVNNPHK

SEQ ID NO: 4857 - protein, 11 aa, Artificial
  IGFBP-2 heparin binding domain-containing peptide sequence
RHRVGVNNPHK

SEQ ID NO: 4858 - protein, 11 aa, Artificial
  IGFBP-2 heparin binding domain-containing peptide sequence
HHRVGVNNPHK

SEQ ID NO: 4859 - protein, 11 aa, Artificial
  IGFBP-2 heparin binding domain-containing peptide sequence
KKRVGVNNPHK

SEQ ID NO: 4860 - protein, 11 aa, Artificial
  IGFBP-2 heparin binding domain-containing peptide sequence
RKRVGVNNPHK

SEQ ID NO: 4861 - protein, 11 aa, Artificial
  IGFBP-2 heparin binding domain-containing peptide sequence
HKRVGVNNPHK

SEQ ID NO: 4862 - protein, 11 aa, Artificial
  IGFBP-2 heparin binding domain-containing peptide sequence
KRRVGVNNPHK

SEQ ID NO: 4863 - protein, 11 aa, Artificial
  IGFBP-2 heparin binding domain-containing peptide sequence
RRRVGVNNPHK

SEQ ID NO: 4864 - protein, 11 aa, Artificial
  IGFBP-2 heparin binding domain-containing peptide sequence
HRRVGVNNPHK

SEQ ID NO: 4865 - protein, 11 aa, Artificial
  IGFBP-2 heparin binding domain-containing peptide sequence
KHHLGLEEPRR

SEQ ID NO: 4866 - protein, 11 aa, Artificial
  IGFBP-2 heparin binding domain-containing peptide sequence
RHHLGLEEPRR

SEQ ID NO: 4867 - protein, 11 aa, Artificial
  IGFBP-2 heparin binding domain-containing peptide sequence
HHHLGLEEPRR

SEQ ID NO: 4868 - protein, 11 aa, Artificial
  IGFBP-2 heparin binding domain-containing peptide sequence
KKHLGLEEPRR

SEQ ID NO: 4869 - protein, 11 aa, Artificial
  IGFBP-2 heparin binding domain-containing peptide sequence
RKHLGLEEPRR

SEQ ID NO: 4870 - protein, 11 aa, Artificial
  IGFBP-2 heparin binding domain-containing peptide sequence
HKHLGLEEPRR

SEQ ID NO: 4871 - protein, 11 aa, Artificial
  IGFBP-2 heparin binding domain-containing peptide sequence
KRHLGLEEPRR

SEQ ID NO: 4872 - protein, 11 aa, Artificial
  IGFBP-2 heparin binding domain-containing peptide sequence
RRHLGLEEPRR

SEQ ID NO: 4873 - protein, 11 aa, Artificial
  IGFBP-2 heparin binding domain-containing peptide sequence
HRHLGLEEPRR

SEQ ID NO: 4874 - protein, 11 aa, Artificial
  IGFBP-2 heparin binding domain-containing peptide sequence
KHKLGLEEPRR

SEQ ID NO: 4875 - protein, 11 aa, Artificial
  IGFBP-2 heparin binding domain-containing peptide sequence
RHKLGLEEPRR

SEQ ID NO: 4876 - protein, 11 aa, Artificial
  IGFBP-2 heparin binding domain-containing peptide sequence
HHKLGLEEPRR

SEQ ID NO: 4877 - protein, 11 aa, Artificial
  IGFBP-2 heparin binding domain-containing peptide sequence
KKKLGLEEPRR

SEQ ID NO: 4878 - protein, 11 aa, Artificial
  IGFBP-2 heparin binding domain-containing peptide sequence
RKKLGLEEPRR

SEQ ID NO: 4879 - protein, 11 aa, Artificial
  IGFBP-2 heparin binding domain-containing peptide sequence
HKKLGLEEPRR

SEQ ID NO: 4880 - protein, 11 aa, Artificial
  IGFBP-2 heparin binding domain-containing peptide sequence
KRKLGLEEPRR

SEQ ID NO: 4881 - protein, 11 aa, Artificial
  IGFBP-2 heparin binding domain-containing peptide sequence
RRKLGLEEPRR

SEQ ID NO: 4882 - protein, 11 aa, Artificial
  IGFBP-2 heparin binding domain-containing peptide sequence
HRKLGLEEPRR

SEQ ID NO: 4883 - protein, 11 aa, Artificial
  IGFBP-2 heparin binding domain-containing peptide sequence
KHRLGLEEPRR

SEQ ID NO: 4884 - protein, 11 aa, Artificial
  IGFBP-2 heparin binding domain-containing peptide sequence
RHRLGLEEPRR

SEQ ID NO: 4885 - protein, 11 aa, Artificial
  IGFBP-2 heparin binding domain-containing peptide sequence
HHRLGLEEPRR

SEQ ID NO: 4886 - protein, 11 aa, Artificial
  IGFBP-2 heparin binding domain-containing peptide sequence
KKRLGLEEPRR

SEQ ID NO: 4887 - protein, 11 aa, Artificial
  IGFBP-2 heparin binding domain-containing peptide sequence
RKRLGLEEPRR

SEQ ID NO: 4888 - protein, 11 aa, Artificial
  IGFBP-2 heparin binding domain-containing peptide sequence
HKRLGLEEPRR

SEQ ID NO: 4889 - protein, 11 aa, Artificial
  IGFBP-2 heparin binding domain-containing peptide sequence
KRRLGLEEPRR

SEQ ID NO: 4890 - protein, 11 aa, Artificial
  IGFBP-2 heparin binding domain-containing peptide sequence
RRRLGLEEPRR

SEQ ID NO: 4891 - protein, 11 aa, Artificial
  IGFBP-2 heparin binding domain-containing peptide sequence
HRRLGLEEPRR

SEQ ID NO: 4892 - protein, 11 aa, Artificial
  IGFBP-2 heparin binding domain-containing peptide sequence
KHHIGLEEPRR

SEQ ID NO: 4893 - protein, 11 aa, Artificial
  IGFBP-2 heparin binding domain-containing peptide sequence
RHHIGLEEPRR

SEQ ID NO: 4894 - protein, 11 aa, Artificial
  IGFBP-2 heparin binding domain-containing peptide sequence
HHHIGLEEPRR

SEQ ID NO: 4895 - protein, 11 aa, Artificial
  IGFBP-2 heparin binding domain-containing peptide sequence
KKHIGLEEPRR

SEQ ID NO: 4896 - protein, 11 aa, Artificial
  IGFBP-2 heparin binding domain-containing peptide sequence
RKHIGLEEPRR

SEQ ID NO: 4897 - protein, 11 aa, Artificial
  IGFBP-2 heparin binding domain-containing peptide sequence
HKHIGLEEPRR

SEQ ID NO: 4898 - protein, 11 aa, Artificial
  IGFBP-2 heparin binding domain-containing peptide sequence
KRHIGLEEPRR

SEQ ID NO: 4899 - protein, 11 aa, Artificial
  IGFBP-2 heparin binding domain-containing peptide sequence
RRHIGLEEPRR

SEQ ID NO: 4900 - protein, 11 aa, Artificial
  IGFBP-2 heparin binding domain-containing peptide sequence
HRHIGLEEPRR

SEQ ID NO: 4901 - protein, 11 aa, Artificial
  IGFBP-2 heparin binding domain-containing peptide sequence
KHKIGLEEPRR

SEQ ID NO: 4902 - protein, 11 aa, Artificial
  IGFBP-2 heparin binding domain-containing peptide sequence
RHKIGLEEPRR

SEQ ID NO: 4903 - protein, 11 aa, Artificial
  IGFBP-2 heparin binding domain-containing peptide sequence
HHKIGLEEPRR

SEQ ID NO: 4904 - protein, 11 aa, Artificial
  IGFBP-2 heparin binding domain-containing peptide sequence
KKKIGLEEPRR

SEQ ID NO: 4905 - protein, 11 aa, Artificial
  IGFBP-2 heparin binding domain-containing peptide sequence
RKKIGLEEPRR

SEQ ID NO: 4906 - protein, 11 aa, Artificial
  IGFBP-2 heparin binding domain-containing peptide sequence
HKKIGLEEPRR

SEQ ID NO: 4907 - protein, 11 aa, Artificial
  IGFBP-2 heparin binding domain-containing peptide sequence
KRKIGLEEPRR

SEQ ID NO: 4908 - protein, 11 aa, Artificial
  IGFBP-2 heparin binding domain-containing peptide sequence
RRKIGLEEPRR

SEQ ID NO: 4909 - protein, 11 aa, Artificial
  IGFBP-2 heparin binding domain-containing peptide sequence
HRKIGLEEPRR

SEQ ID NO: 4910 - protein, 11 aa, Artificial
  IGFBP-2 heparin binding domain-containing peptide sequence
KHRIGLEEPRR

SEQ ID NO: 4911 - protein, 11 aa, Artificial
  IGFBP-2 heparin binding domain-containing peptide sequence
RHRIGLEEPRR

SEQ ID NO: 4912 - protein, 11 aa, Artificial
  IGFBP-2 heparin binding domain-containing peptide sequence
HHRIGLEEPRR

SEQ ID NO: 4913 - protein, 11 aa, Artificial
  IGFBP-2 heparin binding domain-containing peptide sequence
KKRIGLEEPRR

SEQ ID NO: 4914 - protein, 11 aa, Artificial
  IGFBP-2 heparin binding domain-containing peptide sequence
RKRIGLEEPRR

SEQ ID NO: 4915 - protein, 11 aa, Artificial
  IGFBP-2 heparin binding domain-containing peptide sequence
HKRIGLEEPRR

SEQ ID NO: 4916 - protein, 11 aa, Artificial
  IGFBP-2 heparin binding domain-containing peptide sequence
KRRIGLEEPRR

SEQ ID NO: 4917 - protein, 11 aa, Artificial
  IGFBP-2 heparin binding domain-containing peptide sequence
RRRIGLEEPRR

SEQ ID NO: 4918 - protein, 11 aa, Artificial
  IGFBP-2 heparin binding domain-containing peptide sequence
HRRIGLEEPRR

SEQ ID NO: 4919 - protein, 11 aa, Artificial
  IGFBP-2 heparin binding domain-containing peptide sequence
KHHVGLEEPRR

SEQ ID NO: 4920 - protein, 11 aa, Artificial
  IGFBP-2 heparin binding domain-containing peptide sequence
RHHVGLEEPRR

SEQ ID NO: 4921 - protein, 11 aa, Artificial
  IGFBP-2 heparin binding domain-containing peptide sequence
HHHVGLEEPRR

SEQ ID NO: 4922 - protein, 11 aa, Artificial
  IGFBP-2 heparin binding domain-containing peptide sequence
KKHVGLEEPRR

SEQ ID NO: 4923 - protein, 11 aa, Artificial
  IGFBP-2 heparin binding domain-containing peptide sequence
RKHVGLEEPRR

SEQ ID NO: 4924 - protein, 11 aa, Artificial
  IGFBP-2 heparin binding domain-containing peptide sequence
HKHVGLEEPRR

SEQ ID NO: 4925 - protein, 11 aa, Artificial
  IGFBP-2 heparin binding domain-containing peptide sequence
KRHVGLEEPRR

SEQ ID NO: 4926 - protein, 11 aa, Artificial
  IGFBP-2 heparin binding domain-containing peptide sequence
RRHVGLEEPRR

SEQ ID NO: 4927 - protein, 11 aa, Artificial
  IGFBP-2 heparin binding domain-containing peptide sequence
HRHVGLEEPRR

SEQ ID NO: 4928 - protein, 11 aa, Artificial
  IGFBP-2 heparin binding domain-containing peptide sequence
KHKVGLEEPRR

SEQ ID NO: 4929 - protein, 11 aa, Artificial
  IGFBP-2 heparin binding domain-containing peptide sequence
RHKVGLEEPRR

SEQ ID NO: 4930 - protein, 11 aa, Artificial
  IGFBP-2 heparin binding domain-containing peptide sequence
HHKVGLEEPRR

SEQ ID NO: 4931 - protein, 11 aa, Artificial
  IGFBP-2 heparin binding domain-containing peptide sequence
KKKVGLEEPRR

SEQ ID NO: 4932 - protein, 11 aa, Artificial
  IGFBP-2 heparin binding domain-containing peptide sequence
RKKVGLEEPRR

SEQ ID NO: 4933 - protein, 11 aa, Artificial
  IGFBP-2 heparin binding domain-containing peptide sequence
HKKVGLEEPRR

SEQ ID NO: 4934 - protein, 11 aa, Artificial
  IGFBP-2 heparin binding domain-containing peptide sequence
KRKVGLEEPRR

SEQ ID NO: 4935 - protein, 11 aa, Artificial
  IGFBP-2 heparin binding domain-containing peptide sequence
RRKVGLEEPRR

SEQ ID NO: 4936 - protein, 11 aa, Artificial
  IGFBP-2 heparin binding domain-containing peptide sequence
HRKVGLEEPRR

SEQ ID NO: 4937 - protein, 11 aa, Artificial
  IGFBP-2 heparin binding domain-containing peptide sequence
KHRVGLEEPRR

SEQ ID NO: 4938 - protein, 11 aa, Artificial
  IGFBP-2 heparin binding domain-containing peptide sequence
RHRVGLEEPRR

SEQ ID NO: 4939 - protein, 11 aa, Artificial
  IGFBP-2 heparin binding domain-containing peptide sequence
HHRVGLEEPRR

SEQ ID NO: 4940 - protein, 11 aa, Artificial
  IGFBP-2 heparin binding domain-containing peptide sequence
KKRVGLEEPRR

SEQ ID NO: 4941 - protein, 11 aa, Artificial
  IGFBP-2 heparin binding domain-containing peptide sequence
RKRVGLEEPRR

SEQ ID NO: 4942 - protein, 11 aa, Artificial
  IGFBP-2 heparin binding domain-containing peptide sequence
HKRVGLEEPRR

SEQ ID NO: 4943 - protein, 11 aa, Artificial
  IGFBP-2 heparin binding domain-containing peptide sequence
KRRVGLEEPRR

SEQ ID NO: 4944 - protein, 11 aa, Artificial
  IGFBP-2 heparin binding domain-containing peptide sequence
RRRVGLEEPRR

SEQ ID NO: 4945 - protein, 11 aa, Artificial
  IGFBP-2 heparin binding domain-containing peptide sequence
HRRVGLEEPRR

SEQ ID NO: 4946 - protein, 11 aa, Artificial
  IGFBP-2 heparin binding domain-containing peptide sequence
KHHLGIEEPRR

SEQ ID NO: 4947 - protein, 11 aa, Artificial
  IGFBP-2 heparin binding domain-containing peptide sequence
RHHLGIEEPRR

SEQ ID NO: 4948 - protein, 11 aa, Artificial
  IGFBP-2 heparin binding domain-containing peptide sequence
HHHLGIEEPRR

SEQ ID NO: 4949 - protein, 11 aa, Artificial
  IGFBP-2 heparin binding domain-containing peptide sequence
KKHLGIEEPRR

SEQ ID NO: 4950 - protein, 11 aa, Artificial
  IGFBP-2 heparin binding domain-containing peptide sequence
RKHLGIEEPRR

SEQ ID NO: 4951 - protein, 11 aa, Artificial
  IGFBP-2 heparin binding domain-containing peptide sequence
HKHLGIEEPRR

SEQ ID NO: 4952 - protein, 11 aa, Artificial
  IGFBP-2 heparin binding domain-containing peptide sequence
KRHLGIEEPRR

SEQ ID NO: 4953 - protein, 11 aa, Artificial
  IGFBP-2 heparin binding domain-containing peptide sequence
RRHLGIEEPRR

SEQ ID NO: 4954 - protein, 11 aa, Artificial
  IGFBP-2 heparin binding domain-containing peptide sequence
HRHLGIEEPRR

SEQ ID NO: 4955 - protein, 11 aa, Artificial
  IGFBP-2 heparin binding domain-containing peptide sequence
KHKLGIEEPRR

SEQ ID NO: 4956 - protein, 11 aa, Artificial
  IGFBP-2 heparin binding domain-containing peptide sequence
RHKLGIEEPRR

SEQ ID NO: 4957 - protein, 11 aa, Artificial
  IGFBP-2 heparin binding domain-containing peptide sequence
HHKLGIEEPRR

SEQ ID NO: 4958 - protein, 11 aa, Artificial
  IGFBP-2 heparin binding domain-containing peptide sequence
KKKLGIEEPRR

SEQ ID NO: 4959 - protein, 11 aa, Artificial
  IGFBP-2 heparin binding domain-containing peptide sequence
RKKLGIEEPRR

SEQ ID NO: 4960 - protein, 11 aa, Artificial
  IGFBP-2 heparin binding domain-containing peptide sequence
HKKLGIEEPRR

SEQ ID NO: 4961 - protein, 11 aa, Artificial
  IGFBP-2 heparin binding domain-containing peptide sequence
KRKLGIEEPRR

SEQ ID NO: 4962 - protein, 11 aa, Artificial
  IGFBP-2 heparin binding domain-containing peptide sequence
RRKLGIEEPRR

SEQ ID NO: 4963 - protein, 11 aa, Artificial
  IGFBP-2 heparin binding domain-containing peptide sequence
HRKLGIEEPRR

SEQ ID NO: 4964 - protein, 11 aa, Artificial
  IGFBP-2 heparin binding domain-containing peptide sequence
KHRLGIEEPRR

SEQ ID NO: 4965 - protein, 11 aa, Artificial
  IGFBP-2 heparin binding domain-containing peptide sequence
RHRLGIEEPRR

SEQ ID NO: 4966 - protein, 11 aa, Artificial
  IGFBP-2 heparin binding domain-containing peptide sequence
HHRLGIEEPRR

SEQ ID NO: 4967 - protein, 11 aa, Artificial
  IGFBP-2 heparin binding domain-containing peptide sequence
KKRLGIEEPRR

SEQ ID NO: 4968 - protein, 11 aa, Artificial
  IGFBP-2 heparin binding domain-containing peptide sequence
RKRLGIEEPRR

SEQ ID NO: 4969 - protein, 11 aa, Artificial
  IGFBP-2 heparin binding domain-containing peptide sequence
HKRLGIEEPRR

SEQ ID NO: 4970 - protein, 11 aa, Artificial
  IGFBP-2 heparin binding domain-containing peptide sequence
KRRLGIEEPRR

SEQ ID NO: 4971 - protein, 11 aa, Artificial
  IGFBP-2 heparin binding domain-containing peptide sequence
RRRLGIEEPRR

SEQ ID NO: 4972 - protein, 11 aa, Artificial
  IGFBP-2 heparin binding domain-containing peptide sequence
HRRLGIEEPRR

SEQ ID NO: 4973 - protein, 11 aa, Artificial
  IGFBP-2 heparin binding domain-containing peptide sequence
KHHIGIEEPRR

SEQ ID NO: 4974 - protein, 11 aa, Artificial
  IGFBP-2 heparin binding domain-containing peptide sequence
RHHIGIEEPRR

SEQ ID NO: 4975 - protein, 11 aa, Artificial
  IGFBP-2 heparin binding domain-containing peptide sequence
HHHIGIEEPRR

SEQ ID NO: 4976 - protein, 11 aa, Artificial
  IGFBP-2 heparin binding domain-containing peptide sequence
KKHIGIEEPRR

SEQ ID NO: 4977 - protein, 11 aa, Artificial
  IGFBP-2 heparin binding domain-containing peptide sequence
RKHIGIEEPRR

SEQ ID NO: 4978 - protein, 11 aa, Artificial
  IGFBP-2 heparin binding domain-containing peptide sequence
HKHIGIEEPRR

SEQ ID NO: 4979 - protein, 11 aa, Artificial
  IGFBP-2 heparin binding domain-containing peptide sequence
KRHIGIEEPRR

SEQ ID NO: 4980 - protein, 11 aa, Artificial
  IGFBP-2 heparin binding domain-containing peptide sequence
RRHIGIEEPRR

SEQ ID NO: 4981 - protein, 11 aa, Artificial
  IGFBP-2 heparin binding domain-containing peptide sequence
HRHIGIEEPRR

SEQ ID NO: 4982 - protein, 11 aa, Artificial
  IGFBP-2 heparin binding domain-containing peptide sequence
KHKIGIEEPRR

SEQ ID NO: 4983 - protein, 11 aa, Artificial
  IGFBP-2 heparin binding domain-containing peptide sequence
RHKIGIEEPRR

SEQ ID NO: 4984 - protein, 11 aa, Artificial
  IGFBP-2 heparin binding domain-containing peptide sequence
HHKIGIEEPRR

SEQ ID NO: 4985 - protein, 11 aa, Artificial
  IGFBP-2 heparin binding domain-containing peptide sequence
KKKIGIEEPRR

SEQ ID NO: 4986 - protein, 11 aa, Artificial
  IGFBP-2 heparin binding domain-containing peptide sequence
RKKIGIEEPRR

SEQ ID NO: 4987 - protein, 11 aa, Artificial
  IGFBP-2 heparin binding domain-containing peptide sequence
HKKIGIEEPRR

SEQ ID NO: 4988 - protein, 11 aa, Artificial
  IGFBP-2 heparin binding domain-containing peptide sequence
KRKIGIEEPRR

SEQ ID NO: 4989 - protein, 11 aa, Artificial
  IGFBP-2 heparin binding domain-containing peptide sequence
RRKIGIEEPRR

SEQ ID NO: 4990 - protein, 11 aa, Artificial
  IGFBP-2 heparin binding domain-containing peptide sequence
HRKIGIEEPRR

SEQ ID NO: 4991 - protein, 11 aa, Artificial
  IGFBP-2 heparin binding domain-containing peptide sequence
KHRIGIEEPRR

SEQ ID NO: 4992 - protein, 11 aa, Artificial
  IGFBP-2 heparin binding domain-containing peptide sequence
RHRIGIEEPRR

SEQ ID NO: 4993 - protein, 11 aa, Artificial
  IGFBP-2 heparin binding domain-containing peptide sequence
HHRIGIEEPRR

SEQ ID NO: 4994 - protein, 11 aa, Artificial
  IGFBP-2 heparin binding domain-containing peptide sequence
KKRIGIEEPRR

SEQ ID NO: 4995 - protein, 11 aa, Artificial
  IGFBP-2 heparin binding domain-containing peptide sequence
RKRIGIEEPRR

SEQ ID NO: 4996 - protein, 11 aa, Artificial
  IGFBP-2 heparin binding domain-containing peptide sequence
HKRIGIEEPRR

SEQ ID NO: 4997 - protein, 11 aa, Artificial
  IGFBP-2 heparin binding domain-containing peptide sequence
KRRIGIEEPRR

SEQ ID NO: 4998 - protein, 11 aa, Artificial
  IGFBP-2 heparin binding domain-containing peptide sequence
RRRIGIEEPRR

SEQ ID NO: 4999 - protein, 11 aa, Artificial
  IGFBP-2 heparin binding domain-containing peptide sequence
HRRIGIEEPRR

SEQ ID NO: 5000 - protein, 11 aa, Artificial
  IGFBP-2 heparin binding domain-containing peptide sequence
KHHVGIEEPRR

SEQ ID NO: 5001 - protein, 11 aa, Artificial
  IGFBP-2 heparin binding domain-containing peptide sequence
RHHVGIEEPRR

SEQ ID NO: 5002 - protein, 11 aa, Artificial
  IGFBP-2 heparin binding domain-containing peptide sequence
HHHVGIEEPRR

SEQ ID NO: 5003 - protein, 11 aa, Artificial
  IGFBP-2 heparin binding domain-containing peptide sequence
KKHVGIEEPRR

SEQ ID NO: 5004 - protein, 11 aa, Artificial
  IGFBP-2 heparin binding domain-containing peptide sequence
RKHVGIEEPRR

SEQ ID NO: 5005 - protein, 11 aa, Artificial
  IGFBP-2 heparin binding domain-containing peptide sequence
HKHVGIEEPRR

SEQ ID NO: 5006 - protein, 11 aa, Artificial
  IGFBP-2 heparin binding domain-containing peptide sequence
KRHVGIEEPRR

SEQ ID NO: 5007 - protein, 11 aa, Artificial
  IGFBP-2 heparin binding domain-containing peptide sequence
RRHVGIEEPRR

SEQ ID NO: 5008 - protein, 11 aa, Artificial
  IGFBP-2 heparin binding domain-containing peptide sequence
HRHVGIEEPRR

SEQ ID NO: 5009 - protein, 11 aa, Artificial
  IGFBP-2 heparin binding domain-containing peptide sequence
KHKVGIEEPRR

SEQ ID NO: 5010 - protein, 11 aa, Artificial
  IGFBP-2 heparin binding domain-containing peptide sequence
RHKVGIEEPRR

SEQ ID NO: 5011 - protein, 11 aa, Artificial
  IGFBP-2 heparin binding domain-containing peptide sequence
HHKVGIEEPRR

SEQ ID NO: 5012 - protein, 11 aa, Artificial
  IGFBP-2 heparin binding domain-containing peptide sequence
KKKVGIEEPRR

SEQ ID NO: 5013 - protein, 11 aa, Artificial
  IGFBP-2 heparin binding domain-containing peptide sequence
RKKVGIEEPRR

SEQ ID NO: 5014 - protein, 11 aa, Artificial
  IGFBP-2 heparin binding domain-containing peptide sequence
HKKVGIEEPRR

SEQ ID NO: 5015 - protein, 11 aa, Artificial
  IGFBP-2 heparin binding domain-containing peptide sequence
KRKVGIEEPRR

SEQ ID NO: 5016 - protein, 11 aa, Artificial
  IGFBP-2 heparin binding domain-containing peptide sequence
RRKVGIEEPRR

SEQ ID NO: 5017 - protein, 11 aa, Artificial
  IGFBP-2 heparin binding domain-containing peptide sequence
HRKVGIEEPRR

SEQ ID NO: 5018 - protein, 11 aa, Artificial
  IGFBP-2 heparin binding domain-containing peptide sequence
KHRVGIEEPRR

SEQ ID NO: 5019 - protein, 11 aa, Artificial
  IGFBP-2 heparin binding domain-containing peptide sequence
RHRVGIEEPRR

SEQ ID NO: 5020 - protein, 11 aa, Artificial
  IGFBP-2 heparin binding domain-containing peptide sequence
HHRVGIEEPRR

SEQ ID NO: 5021 - protein, 11 aa, Artificial
  IGFBP-2 heparin binding domain-containing peptide sequence
KKRVGIEEPRR

SEQ ID NO: 5022 - protein, 11 aa, Artificial
  IGFBP-2 heparin binding domain-containing peptide sequence
RKRVGIEEPRR

SEQ ID NO: 5023 - protein, 11 aa, Artificial
  IGFBP-2 heparin binding domain-containing peptide sequence
HKRVGIEEPRR

SEQ ID NO: 5024 - protein, 11 aa, Artificial
  IGFBP-2 heparin binding domain-containing peptide sequence
KRRVGIEEPRR

SEQ ID NO: 5025 - protein, 11 aa, Artificial
  IGFBP-2 heparin binding domain-containing peptide sequence
RRRVGIEEPRR

SEQ ID NO: 5026 - protein, 11 aa, Artificial
  IGFBP-2 heparin binding domain-containing peptide sequence
HRRVGIEEPRR

SEQ ID NO: 5027 - protein, 11 aa, Artificial
  IGFBP-2 heparin binding domain-containing peptide sequence
KHHLGVEEPRR

SEQ ID NO: 5028 - protein, 11 aa, Artificial
  IGFBP-2 heparin binding domain-containing peptide sequence
RHHLGVEEPRR

SEQ ID NO: 5029 - protein, 11 aa, Artificial
  IGFBP-2 heparin binding domain-containing peptide sequence
HHHLGVEEPRR

SEQ ID NO: 5030 - protein, 11 aa, Artificial
  IGFBP-2 heparin binding domain-containing peptide sequence
KKHLGVEEPRR

SEQ ID NO: 5031 - protein, 11 aa, Artificial
  IGFBP-2 heparin binding domain-containing peptide sequence
RKHLGVEEPRR

SEQ ID NO: 5032 - protein, 11 aa, Artificial
  IGFBP-2 heparin binding domain-containing peptide sequence
HKHLGVEEPRR

SEQ ID NO: 5033 - protein, 11 aa, Artificial
  IGFBP-2 heparin binding domain-containing peptide sequence
KRHLGVEEPRR

SEQ ID NO: 5034 - protein, 11 aa, Artificial
  IGFBP-2 heparin binding domain-containing peptide sequence
RRHLGVEEPRR

SEQ ID NO: 5035 - protein, 11 aa, Artificial
  IGFBP-2 heparin binding domain-containing peptide sequence
HRHLGVEEPRR

SEQ ID NO: 5036 - protein, 11 aa, Artificial
  IGFBP-2 heparin binding domain-containing peptide sequence
KHKLGVEEPRR

SEQ ID NO: 5037 - protein, 11 aa, Artificial
  IGFBP-2 heparin binding domain-containing peptide sequence
RHKLGVEEPRR

SEQ ID NO: 5038 - protein, 11 aa, Artificial
  IGFBP-2 heparin binding domain-containing peptide sequence
HHKLGVEEPRR

SEQ ID NO: 5039 - protein, 11 aa, Artificial
  IGFBP-2 heparin binding domain-containing peptide sequence
KKKLGVEEPRR

SEQ ID NO: 5040 - protein, 11 aa, Artificial
  IGFBP-2 heparin binding domain-containing peptide sequence
RKKLGVEEPRR

SEQ ID NO: 5041 - protein, 11 aa, Artificial
  IGFBP-2 heparin binding domain-containing peptide sequence
HKKLGVEEPRR

SEQ ID NO: 5042 - protein, 11 aa, Artificial
  IGFBP-2 heparin binding domain-containing peptide sequence
KRKLGVEEPRR

SEQ ID NO: 5043 - protein, 11 aa, Artificial
  IGFBP-2 heparin binding domain-containing peptide sequence
RRKLGVEEPRR

SEQ ID NO: 5044 - protein, 11 aa, Artificial
  IGFBP-2 heparin binding domain-containing peptide sequence
HRKLGVEEPRR

SEQ ID NO: 5045 - protein, 11 aa, Artificial
  IGFBP-2 heparin binding domain-containing peptide sequence
KHRLGVEEPRR

SEQ ID NO: 5046 - protein, 11 aa, Artificial
  IGFBP-2 heparin binding domain-containing peptide sequence
RHRLGVEEPRR

SEQ ID NO: 5047 - protein, 11 aa, Artificial
  IGFBP-2 heparin binding domain-containing peptide sequence
HHRLGVEEPRR

SEQ ID NO: 5048 - protein, 11 aa, Artificial
  IGFBP-2 heparin binding domain-containing peptide sequence
KKRLGVEEPRR

SEQ ID NO: 5049 - protein, 11 aa, Artificial
  IGFBP-2 heparin binding domain-containing peptide sequence
RKRLGVEEPRR

SEQ ID NO: 5050 - protein, 11 aa, Artificial
  IGFBP-2 heparin binding domain-containing peptide sequence
HKRLGVEEPRR

SEQ ID NO: 5051 - protein, 11 aa, Artificial
  IGFBP-2 heparin binding domain-containing peptide sequence
KRRLGVEEPRR

SEQ ID NO: 5052 - protein, 11 aa, Artificial
  IGFBP-2 heparin binding domain-containing peptide sequence
RRRLGVEEPRR

SEQ ID NO: 5053 - protein, 11 aa, Artificial
  IGFBP-2 heparin binding domain-containing peptide sequence
HRRLGVEEPRR

SEQ ID NO: 5054 - protein, 11 aa, Artificial
  IGFBP-2 heparin binding domain-containing peptide sequence
KHHIGVEEPRR

SEQ ID NO: 5055 - protein, 11 aa, Artificial
  IGFBP-2 heparin binding domain-containing peptide sequence
RHHIGVEEPRR

SEQ ID NO: 5056 - protein, 11 aa, Artificial
  IGFBP-2 heparin binding domain-containing peptide sequence
HHHIGVEEPRR

SEQ ID NO: 5057 - protein, 11 aa, Artificial
  IGFBP-2 heparin binding domain-containing peptide sequence
KKHIGVEEPRR

SEQ ID NO: 5058 - protein, 11 aa, Artificial
  IGFBP-2 heparin binding domain-containing peptide sequence
RKHIGVEEPRR

SEQ ID NO: 5059 - protein, 11 aa, Artificial
  IGFBP-2 heparin binding domain-containing peptide sequence
HKHIGVEEPRR

SEQ ID NO: 5060 - protein, 11 aa, Artificial
  IGFBP-2 heparin binding domain-containing peptide sequence
KRHIGVEEPRR

SEQ ID NO: 5061 - protein, 11 aa, Artificial
  IGFBP-2 heparin binding domain-containing peptide sequence
RRHIGVEEPRR

SEQ ID NO: 5062 - protein, 11 aa, Artificial
  IGFBP-2 heparin binding domain-containing peptide sequence
HRHIGVEEPRR

SEQ ID NO: 5063 - protein, 11 aa, Artificial
  IGFBP-2 heparin binding domain-containing peptide sequence
KHKIGVEEPRR

SEQ ID NO: 5064 - protein, 11 aa, Artificial
  IGFBP-2 heparin binding domain-containing peptide sequence
RHKIGVEEPRR

SEQ ID NO: 5065 - protein, 11 aa, Artificial
  IGFBP-2 heparin binding domain-containing peptide sequence
HHKIGVEEPRR

SEQ ID NO: 5066 - protein, 11 aa, Artificial
  IGFBP-2 heparin binding domain-containing peptide sequence
KKKIGVEEPRR

SEQ ID NO: 5067 - protein, 11 aa, Artificial
  IGFBP-2 heparin binding domain-containing peptide sequence
RKKIGVEEPRR

SEQ ID NO: 5068 - protein, 11 aa, Artificial
  IGFBP-2 heparin binding domain-containing peptide sequence
HKKIGVEEPRR

SEQ ID NO: 5069 - protein, 11 aa, Artificial
  IGFBP-2 heparin binding domain-containing peptide sequence
KRKIGVEEPRR

SEQ ID NO: 5070 - protein, 11 aa, Artificial
  IGFBP-2 heparin binding domain-containing peptide sequence
RRKIGVEEPRR

SEQ ID NO: 5071 - protein, 11 aa, Artificial
  IGFBP-2 heparin binding domain-containing peptide sequence
HRKIGVEEPRR

SEQ ID NO: 5072 - protein, 11 aa, Artificial
  IGFBP-2 heparin binding domain-containing peptide sequence
KHRIGVEEPRR

SEQ ID NO: 5073 - protein, 11 aa, Artificial
  IGFBP-2 heparin binding domain-containing peptide sequence
RHRIGVEEPRR

SEQ ID NO: 5074 - protein, 11 aa, Artificial
  IGFBP-2 heparin binding domain-containing peptide sequence
HHRIGVEEPRR

SEQ ID NO: 5075 - protein, 11 aa, Artificial
  IGFBP-2 heparin binding domain-containing peptide sequence
KKRIGVEEPRR

SEQ ID NO: 5076 - protein, 11 aa, Artificial
  IGFBP-2 heparin binding domain-containing peptide sequence
RKRIGVEEPRR

SEQ ID NO: 5077 - protein, 11 aa, Artificial
  IGFBP-2 heparin binding domain-containing peptide sequence
HKRIGVEEPRR

SEQ ID NO: 5078 - protein, 11 aa, Artificial
  IGFBP-2 heparin binding domain-containing peptide sequence
KRRIGVEEPRR

SEQ ID NO: 5079 - protein, 11 aa, Artificial
  IGFBP-2 heparin binding domain-containing peptide sequence
RRRIGVEEPRR

SEQ ID NO: 5080 - protein, 11 aa, Artificial
  IGFBP-2 heparin binding domain-containing peptide sequence
HRRIGVEEPRR

SEQ ID NO: 5081 - protein, 11 aa, Artificial
  IGFBP-2 heparin binding domain-containing peptide sequence
KHHVGVEEPRR

SEQ ID NO: 5082 - protein, 11 aa, Artificial
  IGFBP-2 heparin binding domain-containing peptide sequence
RHHVGVEEPRR

SEQ ID NO: 5083 - protein, 11 aa, Artificial
  IGFBP-2 heparin binding domain-containing peptide sequence
HHHVGVEEPRR

SEQ ID NO: 5084 - protein, 11 aa, Artificial
  IGFBP-2 heparin binding domain-containing peptide sequence
KKHVGVEEPRR

SEQ ID NO: 5085 - protein, 11 aa, Artificial
  IGFBP-2 heparin binding domain-containing peptide sequence
RKHVGVEEPRR

SEQ ID NO: 5086 - protein, 11 aa, Artificial
  IGFBP-2 heparin binding domain-containing peptide sequence
HKHVGVEEPRR

SEQ ID NO: 5087 - protein, 11 aa, Artificial
  IGFBP-2 heparin binding domain-containing peptide sequence
KRHVGVEEPRR

SEQ ID NO: 5088 - protein, 11 aa, Artificial
  IGFBP-2 heparin binding domain-containing peptide sequence
RRHVGVEEPRR

SEQ ID NO: 5089 - protein, 11 aa, Artificial
  IGFBP-2 heparin binding domain-containing peptide sequence
HRHVGVEEPRR

SEQ ID NO: 5090 - protein, 11 aa, Artificial
  IGFBP-2 heparin binding domain-containing peptide sequence
KHKVGVEEPRR

SEQ ID NO: 5091 - protein, 11 aa, Artificial
  IGFBP-2 heparin binding domain-containing peptide sequence
RHKVGVEEPRR

SEQ ID NO: 5092 - protein, 11 aa, Artificial
  IGFBP-2 heparin binding domain-containing peptide sequence
HHKVGVEEPRR

SEQ ID NO: 5093 - protein, 11 aa, Artificial
  IGFBP-2 heparin binding domain-containing peptide sequence
KKKVGVEEPRR

SEQ ID NO: 5094 - protein, 11 aa, Artificial
  IGFBP-2 heparin binding domain-containing peptide sequence
RKKVGVEEPRR

SEQ ID NO: 5095 - protein, 11 aa, Artificial
  IGFBP-2 heparin binding domain-containing peptide sequence
HKKVGVEEPRR

SEQ ID NO: 5096 - protein, 11 aa, Artificial
  IGFBP-2 heparin binding domain-containing peptide sequence
KRKVGVEEPRR

SEQ ID NO: 5097 - protein, 11 aa, Artificial
  IGFBP-2 heparin binding domain-containing peptide sequence
RRKVGVEEPRR

SEQ ID NO: 5098 - protein, 11 aa, Artificial
  IGFBP-2 heparin binding domain-containing peptide sequence
HRKVGVEEPRR

SEQ ID NO: 5099 - protein, 11 aa, Artificial
  IGFBP-2 heparin binding domain-containing peptide sequence
KHRVGVEEPRR

SEQ ID NO: 5100 - protein, 11 aa, Artificial
  IGFBP-2 heparin binding domain-containing peptide sequence
RHRVGVEEPRR

SEQ ID NO: 5101 - protein, 11 aa, Artificial
  IGFBP-2 heparin binding domain-containing peptide sequence
HHRVGVEEPRR

SEQ ID NO: 5102 - protein, 11 aa, Artificial
  IGFBP-2 heparin binding domain-containing peptide sequence
KKRVGVEEPRR

SEQ ID NO: 5103 - protein, 11 aa, Artificial
  IGFBP-2 heparin binding domain-containing peptide sequence
RKRVGVEEPRR

SEQ ID NO: 5104 - protein, 11 aa, Artificial
  IGFBP-2 heparin binding domain-containing peptide sequence
HKRVGVEEPRR

SEQ ID NO: 5105 - protein, 11 aa, Artificial
  IGFBP-2 heparin binding domain-containing peptide sequence
KRRVGVEEPRR

SEQ ID NO: 5106 - protein, 11 aa, Artificial
  IGFBP-2 heparin binding domain-containing peptide sequence
RRRVGVEEPRR

SEQ ID NO: 5107 - protein, 11 aa, Artificial
  IGFBP-2 heparin binding domain-containing peptide sequence
HRRVGVEEPRR

SEQ ID NO: 5108 - protein, 11 aa, Artificial
  IGFBP-2 heparin binding domain-containing peptide sequence
KHHLGLNEPRR

SEQ ID NO: 5109 - protein, 11 aa, Artificial
  IGFBP-2 heparin binding domain-containing peptide sequence
RHHLGLNEPRR

SEQ ID NO: 5110 - protein, 11 aa, Artificial
  IGFBP-2 heparin binding domain-containing peptide sequence
HHHLGLNEPRR

SEQ ID NO: 5111 - protein, 11 aa, Artificial
  IGFBP-2 heparin binding domain-containing peptide sequence
KKHLGLNEPRR

SEQ ID NO: 5112 - protein, 11 aa, Artificial
  IGFBP-2 heparin binding domain-containing peptide sequence
RKHLGLNEPRR

SEQ ID NO: 5113 - protein, 11 aa, Artificial
  IGFBP-2 heparin binding domain-containing peptide sequence
HKHLGLNEPRR

SEQ ID NO: 5114 - protein, 11 aa, Artificial
  IGFBP-2 heparin binding domain-containing peptide sequence
KRHLGLNEPRR

SEQ ID NO: 5115 - protein, 11 aa, Artificial
  IGFBP-2 heparin binding domain-containing peptide sequence
RRHLGLNEPRR

SEQ ID NO: 5116 - protein, 11 aa, Artificial
  IGFBP-2 heparin binding domain-containing peptide sequence
HRHLGLNEPRR

SEQ ID NO: 5117 - protein, 11 aa, Artificial
  IGFBP-2 heparin binding domain-containing peptide sequence
KHKLGLNEPRR

SEQ ID NO: 5118 - protein, 11 aa, Artificial
  IGFBP-2 heparin binding domain-containing peptide sequence
RHKLGLNEPRR

SEQ ID NO: 5119 - protein, 11 aa, Artificial
  IGFBP-2 heparin binding domain-containing peptide sequence
HHKLGLNEPRR

SEQ ID NO: 5120 - protein, 11 aa, Artificial
  IGFBP-2 heparin binding domain-containing peptide sequence
KKKLGLNEPRR

SEQ ID NO: 5121 - protein, 11 aa, Artificial
  IGFBP-2 heparin binding domain-containing peptide sequence
RKKLGLNEPRR

SEQ ID NO: 5122 - protein, 11 aa, Artificial
  IGFBP-2 heparin binding domain-containing peptide sequence
HKKLGLNEPRR

SEQ ID NO: 5123 - protein, 11 aa, Artificial
  IGFBP-2 heparin binding domain-containing peptide sequence
KRKLGLNEPRR

SEQ ID NO: 5124 - protein, 11 aa, Artificial
  IGFBP-2 heparin binding domain-containing peptide sequence
RRKLGLNEPRR

SEQ ID NO: 5125 - protein, 11 aa, Artificial
  IGFBP-2 heparin binding domain-containing peptide sequence
HRKLGLNEPRR

SEQ ID NO: 5126 - protein, 11 aa, Artificial
  IGFBP-2 heparin binding domain-containing peptide sequence
KHRLGLNEPRR

SEQ ID NO: 5127 - protein, 11 aa, Artificial
  IGFBP-2 heparin binding domain-containing peptide sequence
RHRLGLNEPRR

SEQ ID NO: 5128 - protein, 11 aa, Artificial
  IGFBP-2 heparin binding domain-containing peptide sequence
HHRLGLNEPRR

SEQ ID NO: 5129 - protein, 11 aa, Artificial
  IGFBP-2 heparin binding domain-containing peptide sequence
KKRLGLNEPRR

SEQ ID NO: 5130 - protein, 11 aa, Artificial
  IGFBP-2 heparin binding domain-containing peptide sequence
RKRLGLNEPRR

SEQ ID NO: 5131 - protein, 11 aa, Artificial
  IGFBP-2 heparin binding domain-containing peptide sequence
HKRLGLNEPRR

SEQ ID NO: 5132 - protein, 11 aa, Artificial
  IGFBP-2 heparin binding domain-containing peptide sequence
KRRLGLNEPRR

SEQ ID NO: 5133 - protein, 11 aa, Artificial
  IGFBP-2 heparin binding domain-containing peptide sequence
RRRLGLNEPRR

SEQ ID NO: 5134 - protein, 11 aa, Artificial
  IGFBP-2 heparin binding domain-containing peptide sequence
HRRLGLNEPRR

SEQ ID NO: 5135 - protein, 10 aa, Artificial
  IGFBP-2 heparin binding domain-containing peptide sequence
KHHIGLNPRR

SEQ ID NO: 5136 - protein, 11 aa, Artificial
  IGFBP-2 heparin binding domain-containing peptide sequence
RHHIGLNEPRR

SEQ ID NO: 5137 - protein, 11 aa, Artificial
  IGFBP-2 heparin binding domain-containing peptide sequence
HHHIGLNEPRR

SEQ ID NO: 5138 - protein, 11 aa, Artificial
  IGFBP-2 heparin binding domain-containing peptide sequence
KKHIGLNEPRR

SEQ ID NO: 5139 - protein, 11 aa, Artificial
  IGFBP-2 heparin binding domain-containing peptide sequence
RKHIGLNEPRR

SEQ ID NO: 5140 - protein, 11 aa, Artificial
  IGFBP-2 heparin binding domain-containing peptide sequence
HKHIGLNEPRR

SEQ ID NO: 5141 - protein, 11 aa, Artificial
  IGFBP-2 heparin binding domain-containing peptide sequence
KRHIGLNEPRR

SEQ ID NO: 5142 - protein, 11 aa, Artificial
  IGFBP-2 heparin binding domain-containing peptide sequence
RRHIGLNEPRR

SEQ ID NO: 5143 - protein, 11 aa, Artificial
  IGFBP-2 heparin binding domain-containing peptide sequence
HRHIGLNEPRR

SEQ ID NO: 5144 - protein, 11 aa, Artificial
  IGFBP-2 heparin binding domain-containing peptide sequence
KHKIGLNEPRR

SEQ ID NO: 5145 - protein, 11 aa, Artificial
  IGFBP-2 heparin binding domain-containing peptide sequence
RHKIGLNEPRR

SEQ ID NO: 5146 - protein, 11 aa, Artificial
  IGFBP-2 heparin binding domain-containing peptide sequence
HHKIGLNEPRR

SEQ ID NO: 5147 - protein, 11 aa, Artificial
  IGFBP-2 heparin binding domain-containing peptide sequence
KKKIGLNEPRR

SEQ ID NO: 5148 - protein, 11 aa, Artificial
  IGFBP-2 heparin binding domain-containing peptide sequence
RKKIGLNEPRR

SEQ ID NO: 5149 - protein, 11 aa, Artificial
  IGFBP-2 heparin binding domain-containing peptide sequence
HKKIGLNEPRR

SEQ ID NO: 5150 - protein, 11 aa, Artificial
  IGFBP-2 heparin binding domain-containing peptide sequence
KRKIGLNEPRR

SEQ ID NO: 5151 - protein, 11 aa, Artificial
  IGFBP-2 heparin binding domain-containing peptide sequence
RRKIGLNEPRR

SEQ ID NO: 5152 - protein, 11 aa, Artificial
  IGFBP-2 heparin binding domain-containing peptide sequence
HRKIGLNEPRR

SEQ ID NO: 5153 - protein, 11 aa, Artificial
  IGFBP-2 heparin binding domain-containing peptide sequence
KHRIGLNEPRR

SEQ ID NO: 5154 - protein, 11 aa, Artificial
  IGFBP-2 heparin binding domain-containing peptide sequence
RHRIGLNEPRR

SEQ ID NO: 5155 - protein, 11 aa, Artificial
  IGFBP-2 heparin binding domain-containing peptide sequence
HHRIGLNEPRR

SEQ ID NO: 5156 - protein, 11 aa, Artificial
  IGFBP-2 heparin binding domain-containing peptide sequence
KKRIGLNEPRR

SEQ ID NO: 5157 - protein, 11 aa, Artificial
  IGFBP-2 heparin binding domain-containing peptide sequence
RKRIGLNEPRR

SEQ ID NO: 5158 - protein, 11 aa, Artificial
  IGFBP-2 heparin binding domain-containing peptide sequence
HKRIGLNEPRR

SEQ ID NO: 5159 - protein, 11 aa, Artificial
  IGFBP-2 heparin binding domain-containing peptide sequence
KRRIGLNEPRR

SEQ ID NO: 5160 - protein, 11 aa, Artificial
  IGFBP-2 heparin binding domain-containing peptide sequence
RRRIGLNEPRR

SEQ ID NO: 5161 - protein, 11 aa, Artificial
  IGFBP-2 heparin binding domain-containing peptide sequence
HRRIGLNEPRR

SEQ ID NO: 5162 - protein, 11 aa, Artificial
  IGFBP-2 heparin binding domain-containing peptide sequence
KHHVGLNEPRR

SEQ ID NO: 5163 - protein, 11 aa, Artificial
  IGFBP-2 heparin binding domain-containing peptide sequence
RHHVGLNEPRR

SEQ ID NO: 5164 - protein, 11 aa, Artificial
  IGFBP-2 heparin binding domain-containing peptide sequence
HHHVGLNEPRR

SEQ ID NO: 5165 - protein, 11 aa, Artificial
  IGFBP-2 heparin binding domain-containing peptide sequence
KKHVGLNEPRR

SEQ ID NO: 5166 - protein, 11 aa, Artificial
  IGFBP-2 heparin binding domain-containing peptide sequence
RKHVGLNEPRR

SEQ ID NO: 5167 - protein, 11 aa, Artificial
  IGFBP-2 heparin binding domain-containing peptide sequence
HKHVGLNEPRR

SEQ ID NO: 5168 - protein, 11 aa, Artificial
  IGFBP-2 heparin binding domain-containing peptide sequence
KRHVGLNEPRR

SEQ ID NO: 5169 - protein, 11 aa, Artificial
  IGFBP-2 heparin binding domain-containing peptide sequence
RRHVGLNEPRR

SEQ ID NO: 5170 - protein, 11 aa, Artificial
  IGFBP-2 heparin binding domain-containing peptide sequence
HRHVGLNEPRR

SEQ ID NO: 5171 - protein, 11 aa, Artificial
  IGFBP-2 heparin binding domain-containing peptide sequence
KHKVGLNEPRR

SEQ ID NO: 5172 - protein, 11 aa, Artificial
  IGFBP-2 heparin binding domain-containing peptide sequence
RHKVGLNEPRR

SEQ ID NO: 5173 - protein, 11 aa, Artificial
  IGFBP-2 heparin binding domain-containing peptide sequence
HHKVGLNEPRR

SEQ ID NO: 5174 - protein, 11 aa, Artificial
  IGFBP-2 heparin binding domain-containing peptide sequence
KKKVGLNEPRR

SEQ ID NO: 5175 - protein, 11 aa, Artificial
  IGFBP-2 heparin binding domain-containing peptide sequence
RKKVGLNEPRR

SEQ ID NO: 5176 - protein, 11 aa, Artificial
  IGFBP-2 heparin binding domain-containing peptide sequence
HKKVGLNEPRR

SEQ ID NO: 5177 - protein, 11 aa, Artificial
  IGFBP-2 heparin binding domain-containing peptide sequence
KRKVGLNEPRR

SEQ ID NO: 5178 - protein, 11 aa, Artificial
  IGFBP-2 heparin binding domain-containing peptide sequence
RRKVGLNEPRR

SEQ ID NO: 5179 - protein, 11 aa, Artificial
  IGFBP-2 heparin binding domain-containing peptide sequence
HRKVGLNEPRR

SEQ ID NO: 5180 - protein, 11 aa, Artificial
  IGFBP-2 heparin binding domain-containing peptide sequence
KHRVGLNEPRR

SEQ ID NO: 5181 - protein, 11 aa, Artificial
  IGFBP-2 heparin binding domain-containing peptide sequence
RHRVGLNEPRR

SEQ ID NO: 5182 - protein, 11 aa, Artificial
  IGFBP-2 heparin binding domain-containing peptide sequence
HHRVGLNEPRR

SEQ ID NO: 5183 - protein, 11 aa, Artificial
  IGFBP-2 heparin binding domain-containing peptide sequence
KKRVGLNEPRR

SEQ ID NO: 5184 - protein, 11 aa, Artificial
  IGFBP-2 heparin binding domain-containing peptide sequence
RKRVGLNEPRR

SEQ ID NO: 5185 - protein, 11 aa, Artificial
  IGFBP-2 heparin binding domain-containing peptide sequence
HKRVGLNEPRR

SEQ ID NO: 5186 - protein, 11 aa, Artificial
  IGFBP-2 heparin binding domain-containing peptide sequence
KRRVGLNEPRR

SEQ ID NO: 5187 - protein, 11 aa, Artificial
  IGFBP-2 heparin binding domain-containing peptide sequence
RRRVGLNEPRR

SEQ ID NO: 5188 - protein, 11 aa, Artificial
  IGFBP-2 heparin binding domain-containing peptide sequence
HRRVGLNEPRR

SEQ ID NO: 5189 - protein, 11 aa, Artificial
  IGFBP-2 heparin binding domain-containing peptide sequence
KHHLGINEPRR

SEQ ID NO: 5190 - protein, 11 aa, Artificial
  IGFBP-2 heparin binding domain-containing peptide sequence
RHHLGINEPRR

SEQ ID NO: 5191 - protein, 11 aa, Artificial
  IGFBP-2 heparin binding domain-containing peptide sequence
HHHLGINEPRR

SEQ ID NO: 5192 - protein, 11 aa, Artificial
  IGFBP-2 heparin binding domain-containing peptide sequence
KKHLGINEPRR

SEQ ID NO: 5193 - protein, 11 aa, Artificial
  IGFBP-2 heparin binding domain-containing peptide sequence
RKHLGINEPRR

SEQ ID NO: 5194 - protein, 11 aa, Artificial
  IGFBP-2 heparin binding domain-containing peptide sequence
HKHLGINEPRR

SEQ ID NO: 5195 - protein, 11 aa, Artificial
  IGFBP-2 heparin binding domain-containing peptide sequence
KRHLGINEPRR

SEQ ID NO: 5196 - protein, 11 aa, Artificial
  IGFBP-2 heparin binding domain-containing peptide sequence
RRHLGINEPRR

SEQ ID NO: 5197 - protein, 11 aa, Artificial
  IGFBP-2 heparin binding domain-containing peptide sequence
HRHLGINEPRR

SEQ ID NO: 5198 - protein, 11 aa, Artificial
  IGFBP-2 heparin binding domain-containing peptide sequence
KHKLGINEPRR

SEQ ID NO: 5199 - protein, 11 aa, Artificial
  IGFBP-2 heparin binding domain-containing peptide sequence
RHKLGINEPRR

SEQ ID NO: 5200 - protein, 11 aa, Artificial
  IGFBP-2 heparin binding domain-containing peptide sequence
HHKLGINEPRR

SEQ ID NO: 5201 - protein, 11 aa, Artificial
  IGFBP-2 heparin binding domain-containing peptide sequence
KKKLGINEPRR

SEQ ID NO: 5202 - protein, 11 aa, Artificial
  IGFBP-2 heparin binding domain-containing peptide sequence
RKKLGINEPRR

SEQ ID NO: 5203 - protein, 11 aa, Artificial
  IGFBP-2 heparin binding domain-containing peptide sequence
HKKLGINEPRR

SEQ ID NO: 5204 - protein, 11 aa, Artificial
  IGFBP-2 heparin binding domain-containing peptide sequence
KRKLGINEPRR

SEQ ID NO: 5205 - protein, 11 aa, Artificial
  IGFBP-2 heparin binding domain-containing peptide sequence
RRKLGINEPRR

SEQ ID NO: 5206 - protein, 11 aa, Artificial
  IGFBP-2 heparin binding domain-containing peptide sequence
HRKLGINEPRR

SEQ ID NO: 5207 - protein, 11 aa, Artificial
  IGFBP-2 heparin binding domain-containing peptide sequence
KHRLGINEPRR

SEQ ID NO: 5208 - protein, 11 aa, Artificial
  IGFBP-2 heparin binding domain-containing peptide sequence
RHRLGINEPRR

SEQ ID NO: 5209 - protein, 11 aa, Artificial
  IGFBP-2 heparin binding domain-containing peptide sequence
HHRLGINEPRR

SEQ ID NO: 5210 - protein, 11 aa, Artificial
  IGFBP-2 heparin binding domain-containing peptide sequence
KKRLGINEPRR

SEQ ID NO: 5211 - protein, 11 aa, Artificial
  IGFBP-2 heparin binding domain-containing peptide sequence
RKRLGINEPRR

SEQ ID NO: 5212 - protein, 11 aa, Artificial
  IGFBP-2 heparin binding domain-containing peptide sequence
HKRLGINEPRR

SEQ ID NO: 5213 - protein, 11 aa, Artificial
  IGFBP-2 heparin binding domain-containing peptide sequence
KRRLGINEPRR

SEQ ID NO: 5214 - protein, 11 aa, Artificial
  IGFBP-2 heparin binding domain-containing peptide sequence
RRRLGINEPRR

SEQ ID NO: 5215 - protein, 11 aa, Artificial
  IGFBP-2 heparin binding domain-containing peptide sequence
HRRLGINEPRR

SEQ ID NO: 5216 - protein, 11 aa, Artificial
  IGFBP-2 heparin binding domain-containing peptide sequence
KHHIGIENPRR

SEQ ID NO: 5217 - protein, 11 aa, Artificial
  IGFBP-2 heparin binding domain-containing peptide sequence
RHHIGINEPRR

SEQ ID NO: 5218 - protein, 11 aa, Artificial
  IGFBP-2 heparin binding domain-containing peptide sequence
HHHIGINEPRR

SEQ ID NO: 5219 - protein, 11 aa, Artificial
  IGFBP-2 heparin binding domain-containing peptide sequence
KKHIGINEPRR

SEQ ID NO: 5220 - protein, 11 aa, Artificial
  IGFBP-2 heparin binding domain-containing peptide sequence
RKHIGINEPRR

SEQ ID NO: 5221 - protein, 11 aa, Artificial
  IGFBP-2 heparin binding domain-containing peptide sequence
HKHIGINEPRR

SEQ ID NO: 5222 - protein, 11 aa, Artificial
  IGFBP-2 heparin binding domain-containing peptide sequence
KRHIGINEPRR

SEQ ID NO: 5223 - protein, 11 aa, Artificial
  IGFBP-2 heparin binding domain-containing peptide sequence
RRHIGINEPRR

SEQ ID NO: 5224 - protein, 11 aa, Artificial
  IGFBP-2 heparin binding domain-containing peptide sequence
HRHIGINEPRR

SEQ ID NO: 5225 - protein, 11 aa, Artificial
  IGFBP-2 heparin binding domain-containing peptide sequence
KHKIGINEPRR

SEQ ID NO: 5226 - protein, 11 aa, Artificial
  IGFBP-2 heparin binding domain-containing peptide sequence
RHKIGINEPRR

SEQ ID NO: 5227 - protein, 11 aa, Artificial
  IGFBP-2 heparin binding domain-containing peptide sequence
HHKIGINEPRR

SEQ ID NO: 5228 - protein, 11 aa, Artificial
  IGFBP-2 heparin binding domain-containing peptide sequence
KKKIGINEPRR

SEQ ID NO: 5229 - protein, 11 aa, Artificial
  IGFBP-2 heparin binding domain-containing peptide sequence
RKKIGINEPRR

SEQ ID NO: 5230 - protein, 11 aa, Artificial
  IGFBP-2 heparin binding domain-containing peptide sequence
HKKIGINEPRR

SEQ ID NO: 5231 - protein, 11 aa, Artificial
  IGFBP-2 heparin binding domain-containing peptide sequence
KRKIGINEPRR

SEQ ID NO: 5232 - protein, 11 aa, Artificial
  IGFBP-2 heparin binding domain-containing peptide sequence
RRKIGINEPRR

SEQ ID NO: 5233 - protein, 11 aa, Artificial
  IGFBP-2 heparin binding domain-containing peptide sequence
HRKIGINEPRR

SEQ ID NO: 5234 - protein, 11 aa, Artificial
  IGFBP-2 heparin binding domain-containing peptide sequence
KHRIGINEPRR

SEQ ID NO: 5235 - protein, 11 aa, Artificial
  IGFBP-2 heparin binding domain-containing peptide sequence
RHRIGINEPRR

SEQ ID NO: 5236 - protein, 11 aa, Artificial
  IGFBP-2 heparin binding domain-containing peptide sequence
HHRIGINEPRR

SEQ ID NO: 5237 - protein, 11 aa, Artificial
  IGFBP-2 heparin binding domain-containing peptide sequence
KKRIGINEPRR

SEQ ID NO: 5238 - protein, 11 aa, Artificial
  IGFBP-2 heparin binding domain-containing peptide sequence
RKRIGINEPRR

SEQ ID NO: 5239 - protein, 11 aa, Artificial
  IGFBP-2 heparin binding domain-containing peptide sequence
HKRIGINEPRR

SEQ ID NO: 5240 - protein, 11 aa, Artificial
  IGFBP-2 heparin binding domain-containing peptide sequence
KRRIGINEPRR

SEQ ID NO: 5241 - protein, 11 aa, Artificial
  IGFBP-2 heparin binding domain-containing peptide sequence
RRRIGINEPRR

SEQ ID NO: 5242 - protein, 11 aa, Artificial
  IGFBP-2 heparin binding domain-containing peptide sequence
HRRIGINEPRR

SEQ ID NO: 5243 - protein, 11 aa, Artificial
  IGFBP-2 heparin binding domain-containing peptide sequence
KHHVGINEPRR

SEQ ID NO: 5244 - protein, 11 aa, Artificial
  IGFBP-2 heparin binding domain-containing peptide sequence
RHHVGINEPRR

SEQ ID NO: 5245 - protein, 11 aa, Artificial
  IGFBP-2 heparin binding domain-containing peptide sequence
HHHVGINEPRR

SEQ ID NO: 5246 - protein, 11 aa, Artificial
  IGFBP-2 heparin binding domain-containing peptide sequence
KKHVGINEPRR

SEQ ID NO: 5247 - protein, 11 aa, Artificial
  IGFBP-2 heparin binding domain-containing peptide sequence
RKHVGINEPRR

SEQ ID NO: 5248 - protein, 11 aa, Artificial
  IGFBP-2 heparin binding domain-containing peptide sequence
HKHVGINEPRR

SEQ ID NO: 5249 - protein, 11 aa, Artificial
  IGFBP-2 heparin binding domain-containing peptide sequence
KRHVGINEPRR

SEQ ID NO: 5250 - protein, 11 aa, Artificial
  IGFBP-2 heparin binding domain-containing peptide sequence
RRHVGINEPRR

SEQ ID NO: 5251 - protein, 11 aa, Artificial
  IGFBP-2 heparin binding domain-containing peptide sequence
HRHVGINEPRR

SEQ ID NO: 5252 - protein, 11 aa, Artificial
  IGFBP-2 heparin binding domain-containing peptide sequence
KHKVGINEPRR

SEQ ID NO: 5253 - protein, 11 aa, Artificial
  IGFBP-2 heparin binding domain-containing peptide sequence
RHKVGINEPRR

SEQ ID NO: 5254 - protein, 11 aa, Artificial
  IGFBP-2 heparin binding domain-containing peptide sequence
HHKVGINEPRR

SEQ ID NO: 5255 - protein, 11 aa, Artificial
  IGFBP-2 heparin binding domain-containing peptide sequence
KKKVGINEPRR

SEQ ID NO: 5256 - protein, 11 aa, Artificial
  IGFBP-2 heparin binding domain-containing peptide sequence
RKKVGINEPRR

SEQ ID NO: 5257 - protein, 11 aa, Artificial
  IGFBP-2 heparin binding domain-containing peptide sequence
HKKVGINEPRR

SEQ ID NO: 5258 - protein, 11 aa, Artificial
  IGFBP-2 heparin binding domain-containing peptide sequence
KRKVGINEPRR

SEQ ID NO: 5259 - protein, 11 aa, Artificial
  IGFBP-2 heparin binding domain-containing peptide sequence
RRKVGINEPRR

SEQ ID NO: 5260 - protein, 11 aa, Artificial
  IGFBP-2 heparin binding domain-containing peptide sequence
HRKVGINEPRR

SEQ ID NO: 5261 - protein, 11 aa, Artificial
  IGFBP-2 heparin binding domain-containing peptide sequence
KHRVGINEPRR

SEQ ID NO: 5262 - protein, 11 aa, Artificial
  IGFBP-2 heparin binding domain-containing peptide sequence
RHRVGINEPRR

SEQ ID NO: 5263 - protein, 11 aa, Artificial
  IGFBP-2 heparin binding domain-containing peptide sequence
HHRVGINEPRR

SEQ ID NO: 5264 - protein, 11 aa, Artificial
  IGFBP-2 heparin binding domain-containing peptide sequence
KKRVGINEPRR

SEQ ID NO: 5265 - protein, 11 aa, Artificial
  IGFBP-2 heparin binding domain-containing peptide sequence
RKRVGINEPRR

SEQ ID NO: 5266 - protein, 11 aa, Artificial
  IGFBP-2 heparin binding domain-containing peptide sequence
HKRVGINEPRR

SEQ ID NO: 5267 - protein, 11 aa, Artificial
  IGFBP-2 heparin binding domain-containing peptide sequence
KRRVGINEPRR

SEQ ID NO: 5268 - protein, 11 aa, Artificial
  IGFBP-2 heparin binding domain-containing peptide sequence
RRRVGINEPRR

SEQ ID NO: 5269 - protein, 11 aa, Artificial
  IGFBP-2 heparin binding domain-containing peptide sequence
HRRVGINEPRR

SEQ ID NO: 5270 - protein, 11 aa, Artificial
  IGFBP-2 heparin binding domain-containing peptide sequence
KHHLGVNEPRR

SEQ ID NO: 5271 - protein, 11 aa, Artificial
  IGFBP-2 heparin binding domain-containing peptide sequence
RHHLGVNEPRR

SEQ ID NO: 5272 - protein, 11 aa, Artificial
  IGFBP-2 heparin binding domain-containing peptide sequence
HHHLGVNEPRR

SEQ ID NO: 5273 - protein, 11 aa, Artificial
  IGFBP-2 heparin binding domain-containing peptide sequence
KKHLGVNEPRR

SEQ ID NO: 5274 - protein, 11 aa, Artificial
  IGFBP-2 heparin binding domain-containing peptide sequence
RKHLGVNEPRR

SEQ ID NO: 5275 - protein, 11 aa, Artificial
  IGFBP-2 heparin binding domain-containing peptide sequence
HKHLGVNEPRR

SEQ ID NO: 5276 - protein, 11 aa, Artificial
  IGFBP-2 heparin binding domain-containing peptide sequence
KRHLGVNEPRR

SEQ ID NO: 5277 - protein, 11 aa, Artificial
  IGFBP-2 heparin binding domain-containing peptide sequence
RRHLGVNEPRR

SEQ ID NO: 5278 - protein, 11 aa, Artificial
  IGFBP-2 heparin binding domain-containing peptide sequence
HRHLGVNEPRR

SEQ ID NO: 5279 - protein, 11 aa, Artificial
  IGFBP-2 heparin binding domain-containing peptide sequence
KHKLGVNEPRR

SEQ ID NO: 5280 - protein, 11 aa, Artificial
  IGFBP-2 heparin binding domain-containing peptide sequence
RHKLGVNEPRR

SEQ ID NO: 5281 - protein, 11 aa, Artificial
  IGFBP-2 heparin binding domain-containing peptide sequence
HHKLGVNEPRR

SEQ ID NO: 5282 - protein, 11 aa, Artificial
  IGFBP-2 heparin binding domain-containing peptide sequence
KKKLGVNEPRR

SEQ ID NO: 5283 - protein, 11 aa, Artificial
  IGFBP-2 heparin binding domain-containing peptide sequence
RKKLGVNEPRR

SEQ ID NO: 5284 - protein, 11 aa, Artificial
  IGFBP-2 heparin binding domain-containing peptide sequence
HKKLGVNEPRR

SEQ ID NO: 5285 - protein, 11 aa, Artificial
  IGFBP-2 heparin binding domain-containing peptide sequence
KRKLGVNEPRR

SEQ ID NO: 5286 - protein, 11 aa, Artificial
  IGFBP-2 heparin binding domain-containing peptide sequence
RRKLGVNEPRR

SEQ ID NO: 5287 - protein, 11 aa, Artificial
  IGFBP-2 heparin binding domain-containing peptide sequence
HRKLGVNEPRR

SEQ ID NO: 5288 - protein, 11 aa, Artificial
  IGFBP-2 heparin binding domain-containing peptide sequence
KHRLGVNEPRR

SEQ ID NO: 5289 - protein, 11 aa, Artificial
  IGFBP-2 heparin binding domain-containing peptide sequence
RHRLGVNEPRR

SEQ ID NO: 5290 - protein, 11 aa, Artificial
  IGFBP-2 heparin binding domain-containing peptide sequence
HHRLGVNEPRR

SEQ ID NO: 5291 - protein, 11 aa, Artificial
  IGFBP-2 heparin binding domain-containing peptide sequence
KKRLGVNEPRR

SEQ ID NO: 5292 - protein, 11 aa, Artificial
  IGFBP-2 heparin binding domain-containing peptide sequence
RKRLGVNEPRR

SEQ ID NO: 5293 - protein, 11 aa, Artificial
  IGFBP-2 heparin binding domain-containing peptide sequence
HKRLGVNEPRR

SEQ ID NO: 5294 - protein, 11 aa, Artificial
  IGFBP-2 heparin binding domain-containing peptide sequence
KRRLGVNEPRR

SEQ ID NO: 5295 - protein, 11 aa, Artificial
  IGFBP-2 heparin binding domain-containing peptide sequence
RRRLGVNEPRR

SEQ ID NO: 5296 - protein, 11 aa, Artificial
  IGFBP-2 heparin binding domain-containing peptide sequence
HRRLGVNEPRR

SEQ ID NO: 5297 - protein, 11 aa, Artificial
  IGFBP-2 heparin binding domain-containing peptide sequence
KHHIGVNEPRR

SEQ ID NO: 5298 - protein, 11 aa, Artificial
  IGFBP-2 heparin binding domain-containing peptide sequence
RHHIGVNEPRR

SEQ ID NO: 5299 - protein, 11 aa, Artificial
  IGFBP-2 heparin binding domain-containing peptide sequence
HHHIGVNEPRR

SEQ ID NO: 5300 - protein, 11 aa, Artificial
  IGFBP-2 heparin binding domain-containing peptide sequence
KKHIGVNEPRR

SEQ ID NO: 5301 - protein, 11 aa, Artificial
  IGFBP-2 heparin binding domain-containing peptide sequence
RKHIGVNEPRR

SEQ ID NO: 5302 - protein, 11 aa, Artificial
  IGFBP-2 heparin binding domain-containing peptide sequence
HKHIGVNEPRR

SEQ ID NO: 5303 - protein, 11 aa, Artificial
  IGFBP-2 heparin binding domain-containing peptide sequence
KRHIGVNEPRR

SEQ ID NO: 5304 - protein, 11 aa, Artificial
  IGFBP-2 heparin binding domain-containing peptide sequence
RRHIGVNEPRR

SEQ ID NO: 5305 - protein, 11 aa, Artificial
  IGFBP-2 heparin binding domain-containing peptide sequence
HRHIGVNEPRR

SEQ ID NO: 5306 - protein, 11 aa, Artificial
  IGFBP-2 heparin binding domain-containing peptide sequence
KHKIGVNEPRR

SEQ ID NO: 5307 - protein, 11 aa, Artificial
  IGFBP-2 heparin binding domain-containing peptide sequence
RHKIGVNEPRR

SEQ ID NO: 5308 - protein, 11 aa, Artificial
  IGFBP-2 heparin binding domain-containing peptide sequence
HHKIGVNEPRR

SEQ ID NO: 5309 - protein, 11 aa, Artificial
  IGFBP-2 heparin binding domain-containing peptide sequence
KKKIGVNEPRR

SEQ ID NO: 5310 - protein, 11 aa, Artificial
  IGFBP-2 heparin binding domain-containing peptide sequence
RKKIGVNEPRR

SEQ ID NO: 5311 - protein, 11 aa, Artificial
  IGFBP-2 heparin binding domain-containing peptide sequence
HKKIGVNEPRR

SEQ ID NO: 5312 - protein, 11 aa, Artificial
  IGFBP-2 heparin binding domain-containing peptide sequence
KRKIGVNEPRR

SEQ ID NO: 5313 - protein, 11 aa, Artificial
  IGFBP-2 heparin binding domain-containing peptide sequence
RRKIGVNEPRR

SEQ ID NO: 5314 - protein, 11 aa, Artificial
  IGFBP-2 heparin binding domain-containing peptide sequence
HRKIGVNEPRR

SEQ ID NO: 5315 - protein, 11 aa, Artificial
  IGFBP-2 heparin binding domain-containing peptide sequence
KHRIGVNEPRR

SEQ ID NO: 5316 - protein, 11 aa, Artificial
  IGFBP-2 heparin binding domain-containing peptide sequence
RHRIGVNEPRR

SEQ ID NO: 5317 - protein, 11 aa, Artificial
  IGFBP-2 heparin binding domain-containing peptide sequence
HHRIGVNEPRR

SEQ ID NO: 5318 - protein, 11 aa, Artificial
  IGFBP-2 heparin binding domain-containing peptide sequence
KKRIGVNEPRR

SEQ ID NO: 5319 - protein, 11 aa, Artificial
  IGFBP-2 heparin binding domain-containing peptide sequence
RKRIGVNEPRR

SEQ ID NO: 5320 - protein, 11 aa, Artificial
  IGFBP-2 heparin binding domain-containing peptide sequence
HKRIGVNEPRR

SEQ ID NO: 5321 - protein, 11 aa, Artificial
  IGFBP-2 heparin binding domain-containing peptide sequence
KRRIGVNEPRR

SEQ ID NO: 5322 - protein, 11 aa, Artificial
  IGFBP-2 heparin binding domain-containing peptide sequence
RRRIGVNEPRR

SEQ ID NO: 5323 - protein, 11 aa, Artificial
  IGFBP-2 heparin binding domain-containing peptide sequence
HRRIGVNEPRR

SEQ ID NO: 5324 - protein, 11 aa, Artificial
  IGFBP-2 heparin binding domain-containing peptide sequence
KHHVGVNEPRR

SEQ ID NO: 5325 - protein, 11 aa, Artificial
  IGFBP-2 heparin binding domain-containing peptide sequence
RHHVGVNEPRR

SEQ ID NO: 5326 - protein, 11 aa, Artificial
  IGFBP-2 heparin binding domain-containing peptide sequence
HHHVGVNEPRR

SEQ ID NO: 5327 - protein, 11 aa, Artificial
  IGFBP-2 heparin binding domain-containing peptide sequence
KKHVGVNEPRR

SEQ ID NO: 5328 - protein, 11 aa, Artificial
  IGFBP-2 heparin binding domain-containing peptide sequence
RKHVGVNEPRR

SEQ ID NO: 5329 - protein, 11 aa, Artificial
  IGFBP-2 heparin binding domain-containing peptide sequence
HKHVGVNEPRR

SEQ ID NO: 5330 - protein, 11 aa, Artificial
  IGFBP-2 heparin binding domain-containing peptide sequence
KRHVGVNEPRR

SEQ ID NO: 5331 - protein, 11 aa, Artificial
  IGFBP-2 heparin binding domain-containing peptide sequence
RRHVGVNEPRR

SEQ ID NO: 5332 - protein, 11 aa, Artificial
  IGFBP-2 heparin binding domain-containing peptide sequence
HRHVGVNEPRR

SEQ ID NO: 5333 - protein, 11 aa, Artificial
  IGFBP-2 heparin binding domain-containing peptide sequence
KHKVGVNEPRR

SEQ ID NO: 5334 - protein, 11 aa, Artificial
  IGFBP-2 heparin binding domain-containing peptide sequence
RHKVGVNEPRR

SEQ ID NO: 5335 - protein, 11 aa, Artificial
  IGFBP-2 heparin binding domain-containing peptide sequence
HHKVGVNEPRR

SEQ ID NO: 5336 - protein, 11 aa, Artificial
  IGFBP-2 heparin binding domain-containing peptide sequence
KKKVGVNEPRR

SEQ ID NO: 5337 - protein, 11 aa, Artificial
  IGFBP-2 heparin binding domain-containing peptide sequence
RKKVGVNEPRR

SEQ ID NO: 5338 - protein, 11 aa, Artificial
  IGFBP-2 heparin binding domain-containing peptide sequence
HKKVGVNEPRR

SEQ ID NO: 5339 - protein, 11 aa, Artificial
  IGFBP-2 heparin binding domain-containing peptide sequence
KRKVGVNEPRR

SEQ ID NO: 5340 - protein, 11 aa, Artificial
  IGFBP-2 heparin binding domain-containing peptide sequence
RRKVGVNEPRR

SEQ ID NO: 5341 - protein, 11 aa, Artificial
  IGFBP-2 heparin binding domain-containing peptide sequence
HRKVGVNEPRR

SEQ ID NO: 5342 - protein, 11 aa, Artificial
  IGFBP-2 heparin binding domain-containing peptide sequence
KHRVGVNEPRR

SEQ ID NO: 5343 - protein, 11 aa, Artificial
  IGFBP-2 heparin binding domain-containing peptide sequence
RHRVGVNEPRR

SEQ ID NO: 5344 - protein, 11 aa, Artificial
  IGFBP-2 heparin binding domain-containing peptide sequence
HHRVGVNEPRR

SEQ ID NO: 5345 - protein, 11 aa, Artificial
  IGFBP-2 heparin binding domain-containing peptide sequence
KKRVGVNEPRR

SEQ ID NO: 5346 - protein, 11 aa, Artificial
  IGFBP-2 heparin binding domain-containing peptide sequence
RKRVGVNEPRR

SEQ ID NO: 5347 - protein, 11 aa, Artificial
  IGFBP-2 heparin binding domain-containing peptide sequence
HKRVGVNEPRR

SEQ ID NO: 5348 - protein, 11 aa, Artificial
  IGFBP-2 heparin binding domain-containing peptide sequence
KRRVGVNEPRR

SEQ ID NO: 5349 - protein, 11 aa, Artificial
  IGFBP-2 heparin binding domain-containing peptide sequence
RRRVGVNEPRR

SEQ ID NO: 5350 - protein, 11 aa, Artificial
  IGFBP-2 heparin binding domain-containing peptide sequence
HRRVGVNEPRR

SEQ ID NO: 5351 - protein, 11 aa, Artificial
  IGFBP-2 heparin binding domain-containing peptide sequence
KHHLGLENPRR

SEQ ID NO: 5352 - protein, 11 aa, Artificial
  IGFBP-2 heparin binding domain-containing peptide sequence
RHHLGLENPRR

SEQ ID NO: 5353 - protein, 11 aa, Artificial
  IGFBP-2 heparin binding domain-containing peptide sequence
HHHLGLENPRR

SEQ ID NO: 5354 - protein, 11 aa, Artificial
  IGFBP-2 heparin binding domain-containing peptide sequence
KKHLGLENPRR

SEQ ID NO: 5355 - protein, 11 aa, Artificial
  IGFBP-2 heparin binding domain-containing peptide sequence
RKHLGLENPRR

SEQ ID NO: 5356 - protein, 11 aa, Artificial
  IGFBP-2 heparin binding domain-containing peptide sequence
HKHLGLENPRR

SEQ ID NO: 5357 - protein, 11 aa, Artificial
  IGFBP-2 heparin binding domain-containing peptide sequence
KRHLGLENPRR

SEQ ID NO: 5358 - protein, 11 aa, Artificial
  IGFBP-2 heparin binding domain-containing peptide sequence
RRHLGLENPRR

SEQ ID NO: 5359 - protein, 11 aa, Artificial
  IGFBP-2 heparin binding domain-containing peptide sequence
HRHLGLENPRR

SEQ ID NO: 5360 - protein, 11 aa, Artificial
  IGFBP-2 heparin binding domain-containing peptide sequence
KHKLGLENPRR

SEQ ID NO: 5361 - protein, 11 aa, Artificial
  IGFBP-2 heparin binding domain-containing peptide sequence
RHKLGLENPRR

SEQ ID NO: 5362 - protein, 11 aa, Artificial
  IGFBP-2 heparin binding domain-containing peptide sequence
HHKLGLENPRR

SEQ ID NO: 5363 - protein, 11 aa, Artificial
  IGFBP-2 heparin binding domain-containing peptide sequence
KKKLGLENPRR

SEQ ID NO: 5364 - protein, 11 aa, Artificial
  IGFBP-2 heparin binding domain-containing peptide sequence
RKKLGLENPRR

SEQ ID NO: 5365 - protein, 11 aa, Artificial
  IGFBP-2 heparin binding domain-containing peptide sequence
HKKLGLENPRR

SEQ ID NO: 5366 - protein, 11 aa, Artificial
  IGFBP-2 heparin binding domain-containing peptide sequence
KRKLGLENPRR

SEQ ID NO: 5367 - protein, 11 aa, Artificial
  IGFBP-2 heparin binding domain-containing peptide sequence
RRKLGLENPRR

SEQ ID NO: 5368 - protein, 11 aa, Artificial
  IGFBP-2 heparin binding domain-containing peptide sequence
HRKLGLENPRR

SEQ ID NO: 5369 - protein, 11 aa, Artificial
  IGFBP-2 heparin binding domain-containing peptide sequence
KHRLGLENPRR

SEQ ID NO: 5370 - protein, 11 aa, Artificial
  IGFBP-2 heparin binding domain-containing peptide sequence
RHRLGLENPRR

SEQ ID NO: 5371 - protein, 11 aa, Artificial
  IGFBP-2 heparin binding domain-containing peptide sequence
HHRLGLENPRR

SEQ ID NO: 5372 - protein, 11 aa, Artificial
  IGFBP-2 heparin binding domain-containing peptide sequence
KKRLGLENPRR

SEQ ID NO: 5373 - protein, 11 aa, Artificial
  IGFBP-2 heparin binding domain-containing peptide sequence
RKRLGLENPRR

SEQ ID NO: 5374 - protein, 11 aa, Artificial
  IGFBP-2 heparin binding domain-containing peptide sequence
HKRLGLENPRR

SEQ ID NO: 5375 - protein, 11 aa, Artificial
  IGFBP-2 heparin binding domain-containing peptide sequence
KRRLGLENPRR

SEQ ID NO: 5376 - protein, 11 aa, Artificial
  IGFBP-2 heparin binding domain-containing peptide sequence
RRRLGLENPRR

SEQ ID NO: 5377 - protein, 11 aa, Artificial
  IGFBP-2 heparin binding domain-containing peptide sequence
HRRLGLENPRR

SEQ ID NO: 5378 - protein, 11 aa, Artificial
  IGFBP-2 heparin binding domain-containing peptide sequence
KHHIGLENPRR

SEQ ID NO: 5379 - protein, 11 aa, Artificial
  IGFBP-2 heparin binding domain-containing peptide sequence
RHHIGLENPRR

SEQ ID NO: 5380 - protein, 11 aa, Artificial
  IGFBP-2 heparin binding domain-containing peptide sequence
HHHIGLENPRR

SEQ ID NO: 5381 - protein, 11 aa, Artificial
  IGFBP-2 heparin binding domain-containing peptide sequence
KKHIGLENPRR

SEQ ID NO: 5382 - protein, 11 aa, Artificial
  IGFBP-2 heparin binding domain-containing peptide sequence
RKHIGLENPRR

SEQ ID NO: 5383 - protein, 11 aa, Artificial
  IGFBP-2 heparin binding domain-containing peptide sequence
HKHIGLENPRR

SEQ ID NO: 5384 - protein, 11 aa, Artificial
  IGFBP-2 heparin binding domain-containing peptide sequence
KRHIGLENPRR

SEQ ID NO: 5385 - protein, 11 aa, Artificial
  IGFBP-2 heparin binding domain-containing peptide sequence
RRHIGLENPRR

SEQ ID NO: 5386 - protein, 11 aa, Artificial
  IGFBP-2 heparin binding domain-containing peptide sequence
HRHIGLENPRR

SEQ ID NO: 5387 - protein, 11 aa, Artificial
  IGFBP-2 heparin binding domain-containing peptide sequence
KHKIGLENPRR

SEQ ID NO: 5388 - protein, 11 aa, Artificial
  IGFBP-2 heparin binding domain-containing peptide sequence
RHKIGLENPRR

SEQ ID NO: 5389 - protein, 11 aa, Artificial
  IGFBP-2 heparin binding domain-containing peptide sequence
HHKIGLENPRR

SEQ ID NO: 5390 - protein, 11 aa, Artificial
  IGFBP-2 heparin binding domain-containing peptide sequence
KKKIGLENPRR

SEQ ID NO: 5391 - protein, 11 aa, Artificial
  IGFBP-2 heparin binding domain-containing peptide sequence
RKKIGLENPRR

SEQ ID NO: 5392 - protein, 11 aa, Artificial
  IGFBP-2 heparin binding domain-containing peptide sequence
HKKIGLENPRR

SEQ ID NO: 5393 - protein, 11 aa, Artificial
  IGFBP-2 heparin binding domain-containing peptide sequence
KRKIGLENPRR

SEQ ID NO: 5394 - protein, 11 aa, Artificial
  IGFBP-2 heparin binding domain-containing peptide sequence
RRKIGLENPRR

SEQ ID NO: 5395 - protein, 11 aa, Artificial
  IGFBP-2 heparin binding domain-containing peptide sequence
HRKIGLENPRR

SEQ ID NO: 5396 - protein, 11 aa, Artificial
  IGFBP-2 heparin binding domain-containing peptide sequence
KHRIGLENPRR

SEQ ID NO: 5397 - protein, 11 aa, Artificial
  IGFBP-2 heparin binding domain-containing peptide sequence
RHRIGLENPRR

SEQ ID NO: 5398 - protein, 11 aa, Artificial
  IGFBP-2 heparin binding domain-containing peptide sequence
HHRIGLENPRR

SEQ ID NO: 5399 - protein, 11 aa, Artificial
  IGFBP-2 heparin binding domain-containing peptide sequence
KKRIGLENPRR

SEQ ID NO: 5400 - protein, 11 aa, Artificial
  IGFBP-2 heparin binding domain-containing peptide sequence
RKRIGLENPRR

SEQ ID NO: 5401 - protein, 11 aa, Artificial
  IGFBP-2 heparin binding domain-containing peptide sequence
HKRIGLENPRR

SEQ ID NO: 5402 - protein, 11 aa, Artificial
  IGFBP-2 heparin binding domain-containing peptide sequence
KRRIGLENPRR

SEQ ID NO: 5403 - protein, 11 aa, Artificial
  IGFBP-2 heparin binding domain-containing peptide sequence
RRRIGLENPRR

SEQ ID NO: 5404 - protein, 11 aa, Artificial
  IGFBP-2 heparin binding domain-containing peptide sequence
HRRIGLENPRR

SEQ ID NO: 5405 - protein, 11 aa, Artificial
  IGFBP-2 heparin binding domain-containing peptide sequence
KHHVGLENPRR

SEQ ID NO: 5406 - protein, 11 aa, Artificial
  IGFBP-2 heparin binding domain-containing peptide sequence
RHHVGLENPRR

SEQ ID NO: 5407 - protein, 11 aa, Artificial
  IGFBP-2 heparin binding domain-containing peptide sequence
HHHVGLENPRR

SEQ ID NO: 5408 - protein, 11 aa, Artificial
  IGFBP-2 heparin binding domain-containing peptide sequence
KKHVGLENPRR

SEQ ID NO: 5409 - protein, 11 aa, Artificial
  IGFBP-2 heparin binding domain-containing peptide sequence
RKHVGLENPRR

SEQ ID NO: 5410 - protein, 11 aa, Artificial
  IGFBP-2 heparin binding domain-containing peptide sequence
HKHVGLENPRR

SEQ ID NO: 5411 - protein, 11 aa, Artificial
  IGFBP-2 heparin binding domain-containing peptide sequence
KRHVGLENPRR

SEQ ID NO: 5412 - protein, 11 aa, Artificial
  IGFBP-2 heparin binding domain-containing peptide sequence
RRHVGLENPRR

SEQ ID NO: 5413 - protein, 11 aa, Artificial
  IGFBP-2 heparin binding domain-containing peptide sequence
HRHVGLENPRR

SEQ ID NO: 5414 - protein, 11 aa, Artificial
  IGFBP-2 heparin binding domain-containing peptide sequence
KHKVGLENPRR

SEQ ID NO: 5415 - protein, 11 aa, Artificial
  IGFBP-2 heparin binding domain-containing peptide sequence
RHKVGLENPRR

SEQ ID NO: 5416 - protein, 11 aa, Artificial
  IGFBP-2 heparin binding domain-containing peptide sequence
HHKVGLENPRR

SEQ ID NO: 5417 - protein, 11 aa, Artificial
  IGFBP-2 heparin binding domain-containing peptide sequence
KKKVGLENPRR

SEQ ID NO: 5418 - protein, 11 aa, Artificial
  IGFBP-2 heparin binding domain-containing peptide sequence
RKKVGLENPRR

SEQ ID NO: 5419 - protein, 11 aa, Artificial
  IGFBP-2 heparin binding domain-containing peptide sequence
HKKVGLENPRR

SEQ ID NO: 5420 - protein, 11 aa, Artificial
  IGFBP-2 heparin binding domain-containing peptide sequence
KRKVGLENPRR

SEQ ID NO: 5421 - protein, 11 aa, Artificial
  IGFBP-2 heparin binding domain-containing peptide sequence
RRKVGLENPRR

SEQ ID NO: 5422 - protein, 11 aa, Artificial
  IGFBP-2 heparin binding domain-containing peptide sequence
HRKVGLENPRR

SEQ ID NO: 5423 - protein, 11 aa, Artificial
  IGFBP-2 heparin binding domain-containing peptide sequence
KHRVGLENPRR

SEQ ID NO: 5424 - protein, 11 aa, Artificial
  IGFBP-2 heparin binding domain-containing peptide sequence
RHRVGLENPRR

SEQ ID NO: 5425 - protein, 11 aa, Artificial
  IGFBP-2 heparin binding domain-containing peptide sequence
HHRVGLENPRR

SEQ ID NO: 5426 - protein, 11 aa, Artificial
  IGFBP-2 heparin binding domain-containing peptide sequence
KKRVGLENPRR

SEQ ID NO: 5427 - protein, 11 aa, Artificial
  IGFBP-2 heparin binding domain-containing peptide sequence
RKRVGLENPRR

SEQ ID NO: 5428 - protein, 11 aa, Artificial
  IGFBP-2 heparin binding domain-containing peptide sequence
HKRVGLENPRR

SEQ ID NO: 5429 - protein, 11 aa, Artificial
  IGFBP-2 heparin binding domain-containing peptide sequence
KRRVGLENPRR

SEQ ID NO: 5430 - protein, 11 aa, Artificial
  IGFBP-2 heparin binding domain-containing peptide sequence
RRRVGLENPRR

SEQ ID NO: 5431 - protein, 11 aa, Artificial
  IGFBP-2 heparin binding domain-containing peptide sequence
HRRVGLENPRR

SEQ ID NO: 5432 - protein, 11 aa, Artificial
  IGFBP-2 heparin binding domain-containing peptide sequence
KHHLGIENPRR

SEQ ID NO: 5433 - protein, 11 aa, Artificial
  IGFBP-2 heparin binding domain-containing peptide sequence
RHHLGIENPRR

SEQ ID NO: 5434 - protein, 11 aa, Artificial
  IGFBP-2 heparin binding domain-containing peptide sequence
HHHLGIENPRR

SEQ ID NO: 5435 - protein, 11 aa, Artificial
  IGFBP-2 heparin binding domain-containing peptide sequence
KKHLGIENPRR

SEQ ID NO: 5436 - protein, 11 aa, Artificial
  IGFBP-2 heparin binding domain-containing peptide sequence
RKHLGIENPRR

SEQ ID NO: 5437 - protein, 11 aa, Artificial
  IGFBP-2 heparin binding domain-containing peptide sequence
HKHLGIENPRR

SEQ ID NO: 5438 - protein, 11 aa, Artificial
  IGFBP-2 heparin binding domain-containing peptide sequence
KRHLGIENPRR

SEQ ID NO: 5439 - protein, 11 aa, Artificial
  IGFBP-2 heparin binding domain-containing peptide sequence
RRHLGIENPRR

SEQ ID NO: 5440 - protein, 11 aa, Artificial
  IGFBP-2 heparin binding domain-containing peptide sequence
HRHLGIENPRR

SEQ ID NO: 5441 - protein, 11 aa, Artificial
  IGFBP-2 heparin binding domain-containing peptide sequence
KHKLGIENPRR

SEQ ID NO: 5442 - protein, 11 aa, Artificial
  IGFBP-2 heparin binding domain-containing peptide sequence
RHKLGIENPRR

SEQ ID NO: 5443 - protein, 11 aa, Artificial
  IGFBP-2 heparin binding domain-containing peptide sequence
HHKLGIENPRR

SEQ ID NO: 5444 - protein, 11 aa, Artificial
  IGFBP-2 heparin binding domain-containing peptide sequence
KKKLGIENPRR

SEQ ID NO: 5445 - protein, 11 aa, Artificial
  IGFBP-2 heparin binding domain-containing peptide sequence
RKKLGIENPRR

SEQ ID NO: 5446 - protein, 11 aa, Artificial
  IGFBP-2 heparin binding domain-containing peptide sequence
HKKLGIENPRR

SEQ ID NO: 5447 - protein, 11 aa, Artificial
  IGFBP-2 heparin binding domain-containing peptide sequence
KRKLGIENPRR

SEQ ID NO: 5448 - protein, 11 aa, Artificial
  IGFBP-2 heparin binding domain-containing peptide sequence
RRKLGIENPRR

SEQ ID NO: 5449 - protein, 11 aa, Artificial
  IGFBP-2 heparin binding domain-containing peptide sequence
HRKLGIENPRR

SEQ ID NO: 5450 - protein, 11 aa, Artificial
  IGFBP-2 heparin binding domain-containing peptide sequence
KHRLGIENPRR

SEQ ID NO: 5451 - protein, 11 aa, Artificial
  IGFBP-2 heparin binding domain-containing peptide sequence
RHRLGIENPRR

SEQ ID NO: 5452 - protein, 11 aa, Artificial
  IGFBP-2 heparin binding domain-containing peptide sequence
HHRLGIENPRR

SEQ ID NO: 5453 - protein, 11 aa, Artificial
  IGFBP-2 heparin binding domain-containing peptide sequence
KKRLGIENPRR

SEQ ID NO: 5454 - protein, 11 aa, Artificial
  IGFBP-2 heparin binding domain-containing peptide sequence
RKRLGIENPRR

SEQ ID NO: 5455 - protein, 11 aa, Artificial
  IGFBP-2 heparin binding domain-containing peptide sequence
HKRLGIENPRR

SEQ ID NO: 5456 - protein, 11 aa, Artificial
  IGFBP-2 heparin binding domain-containing peptide sequence
KRRLGIENPRR

SEQ ID NO: 5457 - protein, 11 aa, Artificial
  IGFBP-2 heparin binding domain-containing peptide sequence
RRRLGIENPRR

SEQ ID NO: 5458 - protein, 11 aa, Artificial
  IGFBP-2 heparin binding domain-containing peptide sequence
HRRLGIENPRR

SEQ ID NO: 5459 - protein, 11 aa, Artificial
  IGFBP-2 heparin binding domain-containing peptide sequence
KHHIGIENPRR

SEQ ID NO: 5460 - protein, 11 aa, Artificial
  IGFBP-2 heparin binding domain-containing peptide sequence
RHHIGIENPRR

SEQ ID NO: 5461 - protein, 11 aa, Artificial
  IGFBP-2 heparin binding domain-containing peptide sequence
HHHIGIENPRR

SEQ ID NO: 5462 - protein, 11 aa, Artificial
  IGFBP-2 heparin binding domain-containing peptide sequence
KKHIGIENPRR

SEQ ID NO: 5463 - protein, 11 aa, Artificial
  IGFBP-2 heparin binding domain-containing peptide sequence
RKHIGIENPRR

SEQ ID NO: 5464 - protein, 11 aa, Artificial
  IGFBP-2 heparin binding domain-containing peptide sequence
HKHIGIENPRR

SEQ ID NO: 5465 - protein, 11 aa, Artificial
  IGFBP-2 heparin binding domain-containing peptide sequence
KRHIGIENPRR

SEQ ID NO: 5466 - protein, 11 aa, Artificial
  IGFBP-2 heparin binding domain-containing peptide sequence
RRHIGIENPRR

SEQ ID NO: 5467 - protein, 11 aa, Artificial
  IGFBP-2 heparin binding domain-containing peptide sequence
HRHIGIENPRR

SEQ ID NO: 5468 - protein, 11 aa, Artificial
  IGFBP-2 heparin binding domain-containing peptide sequence
KHKIGIENPRR

SEQ ID NO: 5469 - protein, 11 aa, Artificial
  IGFBP-2 heparin binding domain-containing peptide sequence
RHKIGIENPRR

SEQ ID NO: 5470 - protein, 11 aa, Artificial
  IGFBP-2 heparin binding domain-containing peptide sequence
HHKIGIENPRR

SEQ ID NO: 5471 - protein, 11 aa, Artificial
  IGFBP-2 heparin binding domain-containing peptide sequence
KKKIGIENPRR

SEQ ID NO: 5472 - protein, 11 aa, Artificial
  IGFBP-2 heparin binding domain-containing peptide sequence
RKKIGIENPRR

SEQ ID NO: 5473 - protein, 11 aa, Artificial
  IGFBP-2 heparin binding domain-containing peptide sequence
HKKIGIENPRR

SEQ ID NO: 5474 - protein, 11 aa, Artificial
  IGFBP-2 heparin binding domain-containing peptide sequence
KRKIGIENPRR

SEQ ID NO: 5475 - protein, 11 aa, Artificial
  IGFBP-2 heparin binding domain-containing peptide sequence
RRKIGIENPRR

SEQ ID NO: 5476 - protein, 11 aa, Artificial
  IGFBP-2 heparin binding domain-containing peptide sequence
HRKIGIENPRR

SEQ ID NO: 5477 - protein, 11 aa, Artificial
  IGFBP-2 heparin binding domain-containing peptide sequence
KHRIGIENPRR

SEQ ID NO: 5478 - protein, 11 aa, Artificial
  IGFBP-2 heparin binding domain-containing peptide sequence
RHRIGIENPRR

SEQ ID NO: 5479 - protein, 11 aa, Artificial
  IGFBP-2 heparin binding domain-containing peptide sequence
HHRIGIENPRR

SEQ ID NO: 5480 - protein, 11 aa, Artificial
  IGFBP-2 heparin binding domain-containing peptide sequence
KKRIGIENPRR

SEQ ID NO: 5481 - protein, 11 aa, Artificial
  IGFBP-2 heparin binding domain-containing peptide sequence
RKRIGIENPRR

SEQ ID NO: 5482 - protein, 11 aa, Artificial
  IGFBP-2 heparin binding domain-containing peptide sequence
HKRIGIENPRR

SEQ ID NO: 5483 - protein, 11 aa, Artificial
  IGFBP-2 heparin binding domain-containing peptide sequence
KRRIGIENPRR

SEQ ID NO: 5484 - protein, 11 aa, Artificial
  IGFBP-2 heparin binding domain-containing peptide sequence
RRRIGIENPRR

SEQ ID NO: 5485 - protein, 11 aa, Artificial
  IGFBP-2 heparin binding domain-containing peptide sequence
HRRIGIENPRR

SEQ ID NO: 5486 - protein, 11 aa, Artificial
  IGFBP-2 heparin binding domain-containing peptide sequence
KHHVGIENPRR

SEQ ID NO: 5487 - protein, 11 aa, Artificial
  IGFBP-2 heparin binding domain-containing peptide sequence
RHHVGIENPRR

SEQ ID NO: 5488 - protein, 11 aa, Artificial
  IGFBP-2 heparin binding domain-containing peptide sequence
HHHVGIENPRR

SEQ ID NO: 5489 - protein, 11 aa, Artificial
  IGFBP-2 heparin binding domain-containing peptide sequence
KKHVGIENPRR

SEQ ID NO: 5490 - protein, 11 aa, Artificial
  IGFBP-2 heparin binding domain-containing peptide sequence
RKHVGIENPRR

SEQ ID NO: 5491 - protein, 11 aa, Artificial
  IGFBP-2 heparin binding domain-containing peptide sequence
HKHVGIENPRR

SEQ ID NO: 5492 - protein, 11 aa, Artificial
  IGFBP-2 heparin binding domain-containing peptide sequence
KRHVGIENPRR

SEQ ID NO: 5493 - protein, 11 aa, Artificial
  IGFBP-2 heparin binding domain-containing peptide sequence
RRHVGIENPRR

SEQ ID NO: 5494 - protein, 11 aa, Artificial
  IGFBP-2 heparin binding domain-containing peptide sequence
HRHVGIENPRR

SEQ ID NO: 5495 - protein, 11 aa, Artificial
  IGFBP-2 heparin binding domain-containing peptide sequence
KHKVGIENPRR

SEQ ID NO: 5496 - protein, 11 aa, Artificial
  IGFBP-2 heparin binding domain-containing peptide sequence
RHKVGIENPRR

SEQ ID NO: 5497 - protein, 11 aa, Artificial
  IGFBP-2 heparin binding domain-containing peptide sequence
HHKVGIENPRR

SEQ ID NO: 5498 - protein, 11 aa, Artificial
  IGFBP-2 heparin binding domain-containing peptide sequence
KKKVGIENPRR

SEQ ID NO: 5499 - protein, 11 aa, Artificial
  IGFBP-2 heparin binding domain-containing peptide sequence
RKKVGIENPRR

SEQ ID NO: 5500 - protein, 11 aa, Artificial
  IGFBP-2 heparin binding domain-containing peptide sequence
HKKVGIENPRR

SEQ ID NO: 5501 - protein, 11 aa, Artificial
  IGFBP-2 heparin binding domain-containing peptide sequence
KRKVGIENPRR

SEQ ID NO: 5502 - protein, 11 aa, Artificial
  IGFBP-2 heparin binding domain-containing peptide sequence
RRKVGIENPRR

SEQ ID NO: 5503 - protein, 11 aa, Artificial
  IGFBP-2 heparin binding domain-containing peptide sequence
HRKVGIENPRR

SEQ ID NO: 5504 - protein, 11 aa, Artificial
  IGFBP-2 heparin binding domain-containing peptide sequence
KHRVGIENPRR

SEQ ID NO: 5505 - protein, 11 aa, Artificial
  IGFBP-2 heparin binding domain-containing peptide sequence
RHRVGIENPRR

SEQ ID NO: 5506 - protein, 11 aa, Artificial
  IGFBP-2 heparin binding domain-containing peptide sequence
HHRVGIENPRR

SEQ ID NO: 5507 - protein, 11 aa, Artificial
  IGFBP-2 heparin binding domain-containing peptide sequence
KKRVGIENPRR

SEQ ID NO: 5508 - protein, 11 aa, Artificial
  IGFBP-2 heparin binding domain-containing peptide sequence
RKRVGIENPRR

SEQ ID NO: 5509 - protein, 11 aa, Artificial
  IGFBP-2 heparin binding domain-containing peptide sequence
HKRVGIENPRR

SEQ ID NO: 5510 - protein, 11 aa, Artificial
  IGFBP-2 heparin binding domain-containing peptide sequence
KRRVGIENPRR

SEQ ID NO: 5511 - protein, 11 aa, Artificial
  IGFBP-2 heparin binding domain-containing peptide sequence
RRRVGIENPRR

SEQ ID NO: 5512 - protein, 11 aa, Artificial
  IGFBP-2 heparin binding domain-containing peptide sequence
HRRVGIENPRR

SEQ ID NO: 5513 - protein, 11 aa, Artificial
  IGFBP-2 heparin binding domain-containing peptide sequence
KHHLGVENPRR

SEQ ID NO: 5514 - protein, 11 aa, Artificial
  IGFBP-2 heparin binding domain-containing peptide sequence
RHHLGVENPRR

SEQ ID NO: 5515 - protein, 11 aa, Artificial
  IGFBP-2 heparin binding domain-containing peptide sequence
HHHLGVENPRR

SEQ ID NO: 5516 - protein, 11 aa, Artificial
  IGFBP-2 heparin binding domain-containing peptide sequence
KKHLGVENPRR

SEQ ID NO: 5517 - protein, 11 aa, Artificial
  IGFBP-2 heparin binding domain-containing peptide sequence
RKHLGVENPRR

SEQ ID NO: 5518 - protein, 11 aa, Artificial
  IGFBP-2 heparin binding domain-containing peptide sequence
HKHLGVENPRR

SEQ ID NO: 5519 - protein, 11 aa, Artificial
  IGFBP-2 heparin binding domain-containing peptide sequence
KRHLGVENPRR

SEQ ID NO: 5520 - protein, 11 aa, Artificial
  IGFBP-2 heparin binding domain-containing peptide sequence
RRHLGVENPRR

SEQ ID NO: 5521 - protein, 11 aa, Artificial
  IGFBP-2 heparin binding domain-containing peptide sequence
HRHLGVENPRR

SEQ ID NO: 5522 - protein, 11 aa, Artificial
  IGFBP-2 heparin binding domain-containing peptide sequence
KHKLGVENPRR

SEQ ID NO: 5523 - protein, 11 aa, Artificial
  IGFBP-2 heparin binding domain-containing peptide sequence
RHKLGVENPRR

SEQ ID NO: 5524 - protein, 11 aa, Artificial
  IGFBP-2 heparin binding domain-containing peptide sequence
HHKLGVENPRR

SEQ ID NO: 5525 - protein, 11 aa, Artificial
  IGFBP-2 heparin binding domain-containing peptide sequence
KKKLGVENPRR

SEQ ID NO: 5526 - protein, 11 aa, Artificial
  IGFBP-2 heparin binding domain-containing peptide sequence
RKKLGVENPRR

SEQ ID NO: 5527 - protein, 11 aa, Artificial
  IGFBP-2 heparin binding domain-containing peptide sequence
HKKLGVENPRR

SEQ ID NO: 5528 - protein, 11 aa, Artificial
  IGFBP-2 heparin binding domain-containing peptide sequence
KRKLGVENPRR

SEQ ID NO: 5529 - protein, 11 aa, Artificial
  IGFBP-2 heparin binding domain-containing peptide sequence
RRKLGVENPRR

SEQ ID NO: 5530 - protein, 11 aa, Artificial
  IGFBP-2 heparin binding domain-containing peptide sequence
HRKLGVENPRR

SEQ ID NO: 5531 - protein, 11 aa, Artificial
  IGFBP-2 heparin binding domain-containing peptide sequence
KHRLGVENPRR

SEQ ID NO: 5532 - protein, 11 aa, Artificial
  IGFBP-2 heparin binding domain-containing peptide sequence
RHRLGVENPRR

SEQ ID NO: 5533 - protein, 11 aa, Artificial
  IGFBP-2 heparin binding domain-containing peptide sequence
HHRLGVENPRR

SEQ ID NO: 5534 - protein, 11 aa, Artificial
  IGFBP-2 heparin binding domain-containing peptide sequence
KKRLGVENPRR

SEQ ID NO: 5535 - protein, 11 aa, Artificial
  IGFBP-2 heparin binding domain-containing peptide sequence
RKRLGVENPRR

SEQ ID NO: 5536 - protein, 11 aa, Artificial
  IGFBP-2 heparin binding domain-containing peptide sequence
HKRLGVENPRR

SEQ ID NO: 5537 - protein, 11 aa, Artificial
  IGFBP-2 heparin binding domain-containing peptide sequence
KRRLGVENPRR

SEQ ID NO: 5538 - protein, 11 aa, Artificial
  IGFBP-2 heparin binding domain-containing peptide sequence
RRRLGVENPRR

SEQ ID NO: 5539 - protein, 11 aa, Artificial
  IGFBP-2 heparin binding domain-containing peptide sequence
HRRLGVENPRR

SEQ ID NO: 5540 - protein, 11 aa, Artificial
  IGFBP-2 heparin binding domain-containing peptide sequence
KHHIGVENPRR

SEQ ID NO: 5541 - protein, 11 aa, Artificial
  IGFBP-2 heparin binding domain-containing peptide sequence
RHHIGVEEPRR

SEQ ID NO: 5542 - protein, 11 aa, Artificial
  IGFBP-2 heparin binding domain-containing peptide sequence
HHHIGVENPRR

SEQ ID NO: 5543 - protein, 11 aa, Artificial
  IGFBP-2 heparin binding domain-containing peptide sequence
KKHIGVENPRR

SEQ ID NO: 5544 - protein, 11 aa, Artificial
  IGFBP-2 heparin binding domain-containing peptide sequence
RKHIGVENPRR

SEQ ID NO: 5545 - protein, 11 aa, Artificial
  IGFBP-2 heparin binding domain-containing peptide sequence
HKHIGVENPRR

SEQ ID NO: 5546 - protein, 11 aa, Artificial
  IGFBP-2 heparin binding domain-containing peptide sequence
KRHIGVENPRR

SEQ ID NO: 5547 - protein, 11 aa, Artificial
  IGFBP-2 heparin binding domain-containing peptide sequence
RRHIGVENPRR

SEQ ID NO: 5548 - protein, 11 aa, Artificial
  IGFBP-2 heparin binding domain-containing peptide sequence
HRHIGVENPRR

SEQ ID NO: 5549 - protein, 11 aa, Artificial
  IGFBP-2 heparin binding domain-containing peptide sequence
KHKIGVENPRR

SEQ ID NO: 5550 - protein, 11 aa, Artificial
  IGFBP-2 heparin binding domain-containing peptide sequence
RHKIGVENPRR

SEQ ID NO: 5551 - protein, 11 aa, Artificial
  IGFBP-2 heparin binding domain-containing peptide sequence
HHKIGVENPRR

SEQ ID NO: 5552 - protein, 11 aa, Artificial
  IGFBP-2 heparin binding domain-containing peptide sequence
KKKIGVENPRR

SEQ ID NO: 5553 - protein, 11 aa, Artificial
  IGFBP-2 heparin binding domain-containing peptide sequence
RKKIGVENPRR

SEQ ID NO: 5554 - protein, 11 aa, Artificial
  IGFBP-2 heparin binding domain-containing peptide sequence
HKKIGVENPRR

SEQ ID NO: 5555 - protein, 11 aa, Artificial
  IGFBP-2 heparin binding domain-containing peptide sequence
KRKIGVENPRR

SEQ ID NO: 5556 - protein, 11 aa, Artificial
  IGFBP-2 heparin binding domain-containing peptide sequence
RRKIGVENPRR

SEQ ID NO: 5557 - protein, 11 aa, Artificial
  IGFBP-2 heparin binding domain-containing peptide sequence
HRKIGVENPRR

SEQ ID NO: 5558 - protein, 11 aa, Artificial
  IGFBP-2 heparin binding domain-containing peptide sequence
KHRIGVENPRR

SEQ ID NO: 5559 - protein, 11 aa, Artificial
  IGFBP-2 heparin binding domain-containing peptide sequence
RHRIGVENPRR

SEQ ID NO: 5560 - protein, 11 aa, Artificial
  IGFBP-2 heparin binding domain-containing peptide sequence
HHRIGVENPRR

SEQ ID NO: 5561 - protein, 11 aa, Artificial
  IGFBP-2 heparin binding domain-containing peptide sequence
KKRIGVENPRR

SEQ ID NO: 5562 - protein, 11 aa, Artificial
  IGFBP-2 heparin binding domain-containing peptide sequence
RKRIGVENPRR

SEQ ID NO: 5563 - protein, 11 aa, Artificial
  IGFBP-2 heparin binding domain-containing peptide sequence
HKRIGVENPRR

SEQ ID NO: 5564 - protein, 11 aa, Artificial
  IGFBP-2 heparin binding domain-containing peptide sequence
KRRIGVENPRR

SEQ ID NO: 5565 - protein, 11 aa, Artificial
  IGFBP-2 heparin binding domain-containing peptide sequence
RRRIGVENPRR

SEQ ID NO: 5566 - protein, 11 aa, Artificial
  IGFBP-2 heparin binding domain-containing peptide sequence
HRRIGVENPRR

SEQ ID NO: 5567 - protein, 11 aa, Artificial
  IGFBP-2 heparin binding domain-containing peptide sequence
KHHVGVENPRR

SEQ ID NO: 5568 - protein, 11 aa, Artificial
  IGFBP-2 heparin binding domain-containing peptide sequence
RHHVGVENPRR

SEQ ID NO: 5569 - protein, 11 aa, Artificial
  IGFBP-2 heparin binding domain-containing peptide sequence
HHHVGVENPRR

SEQ ID NO: 5570 - protein, 11 aa, Artificial
  IGFBP-2 heparin binding domain-containing peptide sequence
KKHVGVENPRR

SEQ ID NO: 5571 - protein, 11 aa, Artificial
  IGFBP-2 heparin binding domain-containing peptide sequence
RKHVGVENPRR

SEQ ID NO: 5572 - protein, 11 aa, Artificial
  IGFBP-2 heparin binding domain-containing peptide sequence
HKHVGVENPRR

SEQ ID NO: 5573 - protein, 11 aa, Artificial
  IGFBP-2 heparin binding domain-containing peptide sequence
KRHVGVENPRR

SEQ ID NO: 5574 - protein, 11 aa, Artificial
  IGFBP-2 heparin binding domain-containing peptide sequence
RRHVGVENPRR

SEQ ID NO: 5575 - protein, 11 aa, Artificial
  IGFBP-2 heparin binding domain-containing peptide sequence
HRHVGVENPRR

SEQ ID NO: 5576 - protein, 11 aa, Artificial
  IGFBP-2 heparin binding domain-containing peptide sequence
KHKVGVENPRR

SEQ ID NO: 5577 - protein, 11 aa, Artificial
  IGFBP-2 heparin binding domain-containing peptide sequence
RHKVGVENPRR

SEQ ID NO: 5578 - protein, 11 aa, Artificial
  IGFBP-2 heparin binding domain-containing peptide sequence
HHKVGVENPRR

SEQ ID NO: 5579 - protein, 11 aa, Artificial
  IGFBP-2 heparin binding domain-containing peptide sequence
KKKVGVENPRR

SEQ ID NO: 5580 - protein, 11 aa, Artificial
  IGFBP-2 heparin binding domain-containing peptide sequence
RKKVGVENPRR

SEQ ID NO: 5581 - protein, 11 aa, Artificial
  IGFBP-2 heparin binding domain-containing peptide sequence
HKKVGVENPRR

SEQ ID NO: 5582 - protein, 11 aa, Artificial
  IGFBP-2 heparin binding domain-containing peptide sequence
KRKVGVENPRR

SEQ ID NO: 5583 - protein, 11 aa, Artificial
  IGFBP-2 heparin binding domain-containing peptide sequence
RRKVGVEEPRR

SEQ ID NO: 5584 - protein, 11 aa, Artificial
  IGFBP-2 heparin binding domain-containing peptide sequence
HRKVGVENPRR

SEQ ID NO: 5585 - protein, 11 aa, Artificial
  IGFBP-2 heparin binding domain-containing peptide sequence
KHRVGVENPRR

SEQ ID NO: 5586 - protein, 11 aa, Artificial
  IGFBP-2 heparin binding domain-containing peptide sequence
RHRVGVENPRR

SEQ ID NO: 5587 - protein, 11 aa, Artificial
  IGFBP-2 heparin binding domain-containing peptide sequence
HHRVGVENPRR

SEQ ID NO: 5588 - protein, 11 aa, Artificial
  IGFBP-2 heparin binding domain-containing peptide sequence
KKRVGVENPRR

SEQ ID NO: 5589 - protein, 11 aa, Artificial
  IGFBP-2 heparin binding domain-containing peptide sequence
RKRVGVENPRR

SEQ ID NO: 5590 - protein, 11 aa, Artificial
  IGFBP-2 heparin binding domain-containing peptide sequence
HKRVGVENPRR

SEQ ID NO: 5591 - protein, 11 aa, Artificial
  IGFBP-2 heparin binding domain-containing peptide sequence
KRRVGVENPRR

SEQ ID NO: 5592 - protein, 11 aa, Artificial
  IGFBP-2 heparin binding domain-containing peptide sequence
RRRVGVENPRR

SEQ ID NO: 5593 - protein, 11 aa, Artificial
  IGFBP-2 heparin binding domain-containing peptide sequence
HRRVGVENPRR

SEQ ID NO: 5594 - protein, 11 aa, Artificial
  IGFBP-2 heparin binding domain-containing peptide sequence
KHHLGLNNPRR

SEQ ID NO: 5595 - protein, 11 aa, Artificial
  IGFBP-2 heparin binding domain-containing peptide sequence
RHHLGLNNPRR

SEQ ID NO: 5596 - protein, 11 aa, Artificial
  IGFBP-2 heparin binding domain-containing peptide sequence
HHHLGLNNPRR

SEQ ID NO: 5597 - protein, 11 aa, Artificial
  IGFBP-2 heparin binding domain-containing peptide sequence
KKHLGLNNPRR

SEQ ID NO: 5598 - protein, 11 aa, Artificial
  IGFBP-2 heparin binding domain-containing peptide sequence
RKHLGLNNPRR

SEQ ID NO: 5599 - protein, 11 aa, Artificial
  IGFBP-2 heparin binding domain-containing peptide sequence
HKHLGLNNPRR

SEQ ID NO: 5600 - protein, 11 aa, Artificial
  IGFBP-2 heparin binding domain-containing peptide sequence
KRHLGLNNPRR

SEQ ID NO: 5601 - protein, 11 aa, Artificial
  IGFBP-2 heparin binding domain-containing peptide sequence
RRHLGLNNPRR

SEQ ID NO: 5602 - protein, 11 aa, Artificial
  IGFBP-2 heparin binding domain-containing peptide sequence
HRHLGLNNPRR

SEQ ID NO: 5603 - protein, 11 aa, Artificial
  IGFBP-2 heparin binding domain-containing peptide sequence
KHKLGLNNPRR

SEQ ID NO: 5604 - protein, 11 aa, Artificial
  IGFBP-2 heparin binding domain-containing peptide sequence
RHKLGLNNPRR

SEQ ID NO: 5605 - protein, 11 aa, Artificial
  IGFBP-2 heparin binding domain-containing peptide sequence
HHKLGLNNPRR

SEQ ID NO: 5606 - protein, 11 aa, Artificial
  IGFBP-2 heparin binding domain-containing peptide sequence
KKKLGLNNPRR

SEQ ID NO: 5607 - protein, 11 aa, Artificial
  IGFBP-2 heparin binding domain-containing peptide sequence
RKKLGLNNPRR

SEQ ID NO: 5608 - protein, 11 aa, Artificial
  IGFBP-2 heparin binding domain-containing peptide sequence
HKKLGLNNPRR

SEQ ID NO: 5609 - protein, 11 aa, Artificial
  IGFBP-2 heparin binding domain-containing peptide sequence
KRKLGLNNPRR

SEQ ID NO: 5610 - protein, 11 aa, Artificial
  IGFBP-2 heparin binding domain-containing peptide sequence
RRKLGLNNPRR

SEQ ID NO: 5611 - protein, 11 aa, Artificial
  IGFBP-2 heparin binding domain-containing peptide sequence
HRKLGLNNPRR

SEQ ID NO: 5612 - protein, 11 aa, Artificial
  IGFBP-2 heparin binding domain-containing peptide sequence
KHRLGLNNPRR

SEQ ID NO: 5613 - protein, 11 aa, Artificial
  IGFBP-2 heparin binding domain-containing peptide sequence
RHRLGLNNPRR

SEQ ID NO: 5614 - protein, 11 aa, Artificial
  IGFBP-2 heparin binding domain-containing peptide sequence
HHRLGLNNPRR

SEQ ID NO: 5615 - protein, 11 aa, Artificial
  IGFBP-2 heparin binding domain-containing peptide sequence
KKRLGLNNPRR

SEQ ID NO: 5616 - protein, 11 aa, Artificial
  IGFBP-2 heparin binding domain-containing peptide sequence
RKRLGLNNPRR

SEQ ID NO: 5617 - protein, 11 aa, Artificial
  IGFBP-2 heparin binding domain-containing peptide sequence
HKRLGLNNPRR

SEQ ID NO: 5618 - protein, 11 aa, Artificial
  IGFBP-2 heparin binding domain-containing peptide sequence
KRRLGLNNPRR

SEQ ID NO: 5619 - protein, 11 aa, Artificial
  IGFBP-2 heparin binding domain-containing peptide sequence
RRRLGLNNPRR

SEQ ID NO: 5620 - protein, 11 aa, Artificial
  IGFBP-2 heparin binding domain-containing peptide sequence
HRRLGLNNPRR

SEQ ID NO: 5621 - protein, 11 aa, Artificial
  IGFBP-2 heparin binding domain-containing peptide sequence
KHHIGLNNPRR

SEQ ID NO: 5622 - protein, 11 aa, Artificial
  IGFBP-2 heparin binding domain-containing peptide sequence
RHHIGLNNPRR

SEQ ID NO: 5623 - protein, 11 aa, Artificial
  IGFBP-2 heparin binding domain-containing peptide sequence
HHHIGLNNPRR

SEQ ID NO: 5624 - protein, 11 aa, Artificial
  IGFBP-2 heparin binding domain-containing peptide sequence
KKHIGLNNPRR

SEQ ID NO: 5625 - protein, 11 aa, Artificial
  IGFBP-2 heparin binding domain-containing peptide sequence
RKHIGLNNPRR

SEQ ID NO: 5626 - protein, 11 aa, Artificial
  IGFBP-2 heparin binding domain-containing peptide sequence
HKHIGLNNPRR

SEQ ID NO: 5627 - protein, 11 aa, Artificial
  IGFBP-2 heparin binding domain-containing peptide sequence
KRHIGLNNPRR

SEQ ID NO: 5628 - protein, 11 aa, Artificial
  IGFBP-2 heparin binding domain-containing peptide sequence
RRHIGLNNPRR

SEQ ID NO: 5629 - protein, 11 aa, Artificial
  IGFBP-2 heparin binding domain-containing peptide sequence
HRHIGLNNPRR

SEQ ID NO: 5630 - protein, 11 aa, Artificial
  IGFBP-2 heparin binding domain-containing peptide sequence
KHKIGLNNPRR

SEQ ID NO: 5631 - protein, 11 aa, Artificial
  IGFBP-2 heparin binding domain-containing peptide sequence
RHKIGLNNPRR

SEQ ID NO: 5632 - protein, 11 aa, Artificial
  IGFBP-2 heparin binding domain-containing peptide sequence
HHKIGLNNPRR

SEQ ID NO: 5633 - protein, 11 aa, Artificial
  IGFBP-2 heparin binding domain-containing peptide sequence
KKKIGLNNPRR

SEQ ID NO: 5634 - protein, 11 aa, Artificial
  IGFBP-2 heparin binding domain-containing peptide sequence
RKKIGLNNPRR

SEQ ID NO: 5635 - protein, 11 aa, Artificial
  IGFBP-2 heparin binding domain-containing peptide sequence
HKKIGLNNPRR

SEQ ID NO: 5636 - protein, 11 aa, Artificial
  IGFBP-2 heparin binding domain-containing peptide sequence
KRKIGLNNPRR

SEQ ID NO: 5637 - protein, 11 aa, Artificial
  IGFBP-2 heparin binding domain-containing peptide sequence
RRKIGLNNPRR

SEQ ID NO: 5638 - protein, 11 aa, Artificial
  IGFBP-2 heparin binding domain-containing peptide sequence
HRKIGLNNPRR

SEQ ID NO: 5639 - protein, 11 aa, Artificial
  IGFBP-2 heparin binding domain-containing peptide sequence
KHRIGLNNPRR

SEQ ID NO: 5640 - protein, 11 aa, Artificial
  IGFBP-2 heparin binding domain-containing peptide sequence
RHRIGLNNPRR

SEQ ID NO: 5641 - protein, 11 aa, Artificial
  IGFBP-2 heparin binding domain-containing peptide sequence
HHRIGLNNPRR

SEQ ID NO: 5642 - protein, 11 aa, Artificial
  IGFBP-2 heparin binding domain-containing peptide sequence
KKRIGLNNPRR

SEQ ID NO: 5643 - protein, 11 aa, Artificial
  IGFBP-2 heparin binding domain-containing peptide sequence
RKRIGLNNPRR

SEQ ID NO: 5644 - protein, 11 aa, Artificial
  IGFBP-2 heparin binding domain-containing peptide sequence
HKRIGLNNPRR

SEQ ID NO: 5645 - protein, 11 aa, Artificial
  IGFBP-2 heparin binding domain-containing peptide sequence
KRRIGLNNPRR

SEQ ID NO: 5646 - protein, 11 aa, Artificial
  IGFBP-2 heparin binding domain-containing peptide sequence
RRRIGLNNPRR

SEQ ID NO: 5647 - protein, 11 aa, Artificial
  IGFBP-2 heparin binding domain-containing peptide sequence
HRRIGLNNPRR

SEQ ID NO: 5648 - protein, 11 aa, Artificial
  IGFBP-2 heparin binding domain-containing peptide sequence
KHHVGLNNPRR

SEQ ID NO: 5649 - protein, 11 aa, Artificial
  IGFBP-2 heparin binding domain-containing peptide sequence
RHHVGLNNPRR

SEQ ID NO: 5650 - protein, 11 aa, Artificial
  IGFBP-2 heparin binding domain-containing peptide sequence
HHHVGLNNPRR

SEQ ID NO: 5651 - protein, 11 aa, Artificial
  IGFBP-2 heparin binding domain-containing peptide sequence
KKHVGLNNPRR

SEQ ID NO: 5652 - protein, 11 aa, Artificial
  IGFBP-2 heparin binding domain-containing peptide sequence
RKHVGLNNPRR

SEQ ID NO: 5653 - protein, 11 aa, Artificial
  IGFBP-2 heparin binding domain-containing peptide sequence
HKHVGLNNPRR

SEQ ID NO: 5654 - protein, 11 aa, Artificial
  IGFBP-2 heparin binding domain-containing peptide sequence
KRHVGLNNPRR

SEQ ID NO: 5655 - protein, 11 aa, Artificial
  IGFBP-2 heparin binding domain-containing peptide sequence
RRHVGLNNPRR

SEQ ID NO: 5656 - protein, 11 aa, Artificial
  IGFBP-2 heparin binding domain-containing peptide sequence
HRHVGLNNPRR

SEQ ID NO: 5657 - protein, 11 aa, Artificial
  IGFBP-2 heparin binding domain-containing peptide sequence
KHKVGLNNPRR

SEQ ID NO: 5658 - protein, 11 aa, Artificial
  IGFBP-2 heparin binding domain-containing peptide sequence
RHKVGLNNPRR

SEQ ID NO: 5659 - protein, 11 aa, Artificial
  IGFBP-2 heparin binding domain-containing peptide sequence
HHKVGLNNPRR

SEQ ID NO: 5660 - protein, 11 aa, Artificial
  IGFBP-2 heparin binding domain-containing peptide sequence
KKKVGLNNPRR

SEQ ID NO: 5661 - protein, 11 aa, Artificial
  IGFBP-2 heparin binding domain-containing peptide sequence
RKKVGLNNPRR

SEQ ID NO: 5662 - protein, 11 aa, Artificial
  IGFBP-2 heparin binding domain-containing peptide sequence
HKKVGLNNPRR

SEQ ID NO: 5663 - protein, 11 aa, Artificial
  IGFBP-2 heparin binding domain-containing peptide sequence
KRKVGLNNPRR

SEQ ID NO: 5664 - protein, 11 aa, Artificial
  IGFBP-2 heparin binding domain-containing peptide sequence
RRKVGLNNPRR

SEQ ID NO: 5665 - protein, 11 aa, Artificial
  IGFBP-2 heparin binding domain-containing peptide sequence
HRKVGLNNPRR

SEQ ID NO: 5666 - protein, 11 aa, Artificial
  IGFBP-2 heparin binding domain-containing peptide sequence
KHRVGLNNPRR

SEQ ID NO: 5667 - protein, 11 aa, Artificial
  IGFBP-2 heparin binding domain-containing peptide sequence
RHRVGLNNPRR

SEQ ID NO: 5668 - protein, 11 aa, Artificial
  IGFBP-2 heparin binding domain-containing peptide sequence
HHRVGLNNPRR

SEQ ID NO: 5669 - protein, 11 aa, Artificial
  IGFBP-2 heparin binding domain-containing peptide sequence
KKRVGLNNPRR

SEQ ID NO: 5670 - protein, 11 aa, Artificial
  IGFBP-2 heparin binding domain-containing peptide sequence
RKRVGLNNPRR

SEQ ID NO: 5671 - protein, 11 aa, Artificial
  IGFBP-2 heparin binding domain-containing peptide sequence
HKRVGLNNPRR

SEQ ID NO: 5672 - protein, 11 aa, Artificial
  IGFBP-2 heparin binding domain-containing peptide sequence
KRRVGLNNPRR

SEQ ID NO: 5673 - protein, 11 aa, Artificial
  IGFBP-2 heparin binding domain-containing peptide sequence
RRRVGLNNPRR

SEQ ID NO: 5674 - protein, 11 aa, Artificial
  IGFBP-2 heparin binding domain-containing peptide sequence
HRRVGLNNPRR

SEQ ID NO: 5675 - protein, 11 aa, Artificial
  IGFBP-2 heparin binding domain-containing peptide sequence
KHHLGINNPRR

SEQ ID NO: 5676 - protein, 11 aa, Artificial
  IGFBP-2 heparin binding domain-containing peptide sequence
RHHLGINNPRR

SEQ ID NO: 5677 - protein, 11 aa, Artificial
  IGFBP-2 heparin binding domain-containing peptide sequence
HHHLGINNPRR

SEQ ID NO: 5678 - protein, 11 aa, Artificial
  IGFBP-2 heparin binding domain-containing peptide sequence
KKHLGINNPRR

SEQ ID NO: 5679 - protein, 11 aa, Artificial
  IGFBP-2 heparin binding domain-containing peptide sequence
RKHLGINNPRR

SEQ ID NO: 5680 - protein, 11 aa, Artificial
  IGFBP-2 heparin binding domain-containing peptide sequence
HKHLGINNPRR

SEQ ID NO: 5681 - protein, 11 aa, Artificial
  IGFBP-2 heparin binding domain-containing peptide sequence
KRHLGINNPRR

SEQ ID NO: 5682 - protein, 11 aa, Artificial
  IGFBP-2 heparin binding domain-containing peptide sequence
RRHLGINNPRR

SEQ ID NO: 5683 - protein, 11 aa, Artificial
  IGFBP-2 heparin binding domain-containing peptide sequence
HRHLGINNPRR

SEQ ID NO: 5684 - protein, 11 aa, Artificial
  IGFBP-2 heparin binding domain-containing peptide sequence
KHKLGINNPRR

SEQ ID NO: 5685 - protein, 11 aa, Artificial
  IGFBP-2 heparin binding domain-containing peptide sequence
RHKLGINNPRR

SEQ ID NO: 5686 - protein, 11 aa, Artificial
  IGFBP-2 heparin binding domain-containing peptide sequence
HHKLGINNPRR

SEQ ID NO: 5687 - protein, 11 aa, Artificial
  IGFBP-2 heparin binding domain-containing peptide sequence
KKKLGINNPRR

SEQ ID NO: 5688 - protein, 11 aa, Artificial
  IGFBP-2 heparin binding domain-containing peptide sequence
RKKLGINNPRR

SEQ ID NO: 5689 - protein, 11 aa, Artificial
  IGFBP-2 heparin binding domain-containing peptide sequence
HKKLGINNPRR

SEQ ID NO: 5690 - protein, 11 aa, Artificial
  IGFBP-2 heparin binding domain-containing peptide sequence
KRKLGINNPRR

SEQ ID NO: 5691 - protein, 11 aa, Artificial
  IGFBP-2 heparin binding domain-containing peptide sequence
RRKLGINNPRR

SEQ ID NO: 5692 - protein, 11 aa, Artificial
  IGFBP-2 heparin binding domain-containing peptide sequence
HRKLGINNPRR

SEQ ID NO: 5693 - protein, 11 aa, Artificial
  IGFBP-2 heparin binding domain-containing peptide sequence
KHRLGINNPRR

SEQ ID NO: 5694 - protein, 11 aa, Artificial
  IGFBP-2 heparin binding domain-containing peptide sequence
RHRLGINNPRR

SEQ ID NO: 5695 - protein, 11 aa, Artificial
  IGFBP-2 heparin binding domain-containing peptide sequence
HHRLGINNPRR

SEQ ID NO: 5696 - protein, 11 aa, Artificial
  IGFBP-2 heparin binding domain-containing peptide sequence
KKRLGINNPRR

SEQ ID NO: 5697 - protein, 11 aa, Artificial
  IGFBP-2 heparin binding domain-containing peptide sequence
RKRLGINNPRR

SEQ ID NO: 5698 - protein, 11 aa, Artificial
  IGFBP-2 heparin binding domain-containing peptide sequence
HKRLGINNPRR

SEQ ID NO: 5699 - protein, 11 aa, Artificial
  IGFBP-2 heparin binding domain-containing peptide sequence
KRRLGINNPRR

SEQ ID NO: 5700 - protein, 11 aa, Artificial
  IGFBP-2 heparin binding domain-containing peptide sequence
RRRLGINNPRR

SEQ ID NO: 5701 - protein, 11 aa, Artificial
  IGFBP-2 heparin binding domain-containing peptide sequence
HRRLGINNPRR

SEQ ID NO: 5702 - protein, 11 aa, Artificial
  IGFBP-2 heparin binding domain-containing peptide sequence
KHHIGIENPRR

SEQ ID NO: 5703 - protein, 11 aa, Artificial
  IGFBP-2 heparin binding domain-containing peptide sequence
RHHIGINNPRR

SEQ ID NO: 5704 - protein, 11 aa, Artificial
  IGFBP-2 heparin binding domain-containing peptide sequence
HHHIGINNPRR

SEQ ID NO: 5705 - protein, 11 aa, Artificial
  IGFBP-2 heparin binding domain-containing peptide sequence
KKHIGINNPRR

SEQ ID NO: 5706 - protein, 11 aa, Artificial
  IGFBP-2 heparin binding domain-containing peptide sequence
RKHIGINNPRR

SEQ ID NO: 5707 - protein, 11 aa, Artificial
  IGFBP-2 heparin binding domain-containing peptide sequence
HKHIGINNPRR

SEQ ID NO: 5708 - protein, 11 aa, Artificial
  IGFBP-2 heparin binding domain-containing peptide sequence
KRHIGINNPRR

SEQ ID NO: 5709 - protein, 11 aa, Artificial
  IGFBP-2 heparin binding domain-containing peptide sequence
RRHIGINNPRR

SEQ ID NO: 5710 - protein, 11 aa, Artificial
  IGFBP-2 heparin binding domain-containing peptide sequence
HRHIGINNPRR

SEQ ID NO: 5711 - protein, 11 aa, Artificial
  IGFBP-2 heparin binding domain-containing peptide sequence
KHKIGINNPRR

SEQ ID NO: 5712 - protein, 11 aa, Artificial
  IGFBP-2 heparin binding domain-containing peptide sequence
RHKIGINNPRR

SEQ ID NO: 5713 - protein, 11 aa, Artificial
  IGFBP-2 heparin binding domain-containing peptide sequence
HHKIGINNPRR

SEQ ID NO: 5714 - protein, 11 aa, Artificial
  IGFBP-2 heparin binding domain-containing peptide sequence
KKKIGINNPRR

SEQ ID NO: 5715 - protein, 11 aa, Artificial
  IGFBP-2 heparin binding domain-containing peptide sequence
RKKIGINNPRR

SEQ ID NO: 5716 - protein, 11 aa, Artificial
  IGFBP-2 heparin binding domain-containing peptide sequence
HKKIGINNPRR

SEQ ID NO: 5717 - protein, 11 aa, Artificial
  IGFBP-2 heparin binding domain-containing peptide sequence
KRKIGINNPRR

SEQ ID NO: 5718 - protein, 11 aa, Artificial
  IGFBP-2 heparin binding domain-containing peptide sequence
RRKIGINNPRR

SEQ ID NO: 5719 - protein, 11 aa, Artificial
  IGFBP-2 heparin binding domain-containing peptide sequence
HRKIGINNPRR

SEQ ID NO: 5720 - protein, 11 aa, Artificial
  IGFBP-2 heparin binding domain-containing peptide sequence
KHRIGINNPRR

SEQ ID NO: 5721 - protein, 11 aa, Artificial
  IGFBP-2 heparin binding domain-containing peptide sequence
RHRIGINNPRR

SEQ ID NO: 5722 - protein, 11 aa, Artificial
  IGFBP-2 heparin binding domain-containing peptide sequence
HHRIGINNPRR

SEQ ID NO: 5723 - protein, 11 aa, Artificial
  IGFBP-2 heparin binding domain-containing peptide sequence
KKRIGINNPRR

SEQ ID NO: 5724 - protein, 11 aa, Artificial
  IGFBP-2 heparin binding domain-containing peptide sequence
RKRIGINNPRR

SEQ ID NO: 5725 - protein, 11 aa, Artificial
  IGFBP-2 heparin binding domain-containing peptide sequence
HKRIGINNPRR

SEQ ID NO: 5726 - protein, 11 aa, Artificial
  IGFBP-2 heparin binding domain-containing peptide sequence
KRRIGINNPRR

SEQ ID NO: 5727 - protein, 11 aa, Artificial
  IGFBP-2 heparin binding domain-containing peptide sequence
RRRIGINNPRR

SEQ ID NO: 5728 - protein, 11 aa, Artificial
  IGFBP-2 heparin binding domain-containing peptide sequence
HRRIGINNPRR

SEQ ID NO: 5729 - protein, 11 aa, Artificial
  IGFBP-2 heparin binding domain-containing peptide sequence
KHHVGINNPRR

SEQ ID NO: 5730 - protein, 11 aa, Artificial
  IGFBP-2 heparin binding domain-containing peptide sequence
RHHVGINNPRR

SEQ ID NO: 5731 - protein, 11 aa, Artificial
  IGFBP-2 heparin binding domain-containing peptide sequence
HHHVGINNPRR

SEQ ID NO: 5732 - protein, 11 aa, Artificial
  IGFBP-2 heparin binding domain-containing peptide sequence
KKHVGINNPRR

SEQ ID NO: 5733 - protein, 11 aa, Artificial
  IGFBP-2 heparin binding domain-containing peptide sequence
RKHVGINNPRR

SEQ ID NO: 5734 - protein, 11 aa, Artificial
  IGFBP-2 heparin binding domain-containing peptide sequence
HKHVGINNPRR

SEQ ID NO: 5735 - protein, 11 aa, Artificial
  IGFBP-2 heparin binding domain-containing peptide sequence
KRHVGINNPRR

SEQ ID NO: 5736 - protein, 11 aa, Artificial
  IGFBP-2 heparin binding domain-containing peptide sequence
RRHVGINNPRR

SEQ ID NO: 5737 - protein, 11 aa, Artificial
  IGFBP-2 heparin binding domain-containing peptide sequence
HRHVGINNPRR

SEQ ID NO: 5738 - protein, 11 aa, Artificial
  IGFBP-2 heparin binding domain-containing peptide sequence
KHKVGINNPRR

SEQ ID NO: 5739 - protein, 11 aa, Artificial
  IGFBP-2 heparin binding domain-containing peptide sequence
RHKVGINNPRR

SEQ ID NO: 5740 - protein, 11 aa, Artificial
  IGFBP-2 heparin binding domain-containing peptide sequence
HHKVGINNPRR

SEQ ID NO: 5741 - protein, 11 aa, Artificial
  IGFBP-2 heparin binding domain-containing peptide sequence
KKKVGINNPRR

SEQ ID NO: 5742 - protein, 11 aa, Artificial
  IGFBP-2 heparin binding domain-containing peptide sequence
RKKVGINNPRR

SEQ ID NO: 5743 - protein, 11 aa, Artificial
  IGFBP-2 heparin binding domain-containing peptide sequence
HKKVGINNPRR

SEQ ID NO: 5744 - protein, 11 aa, Artificial
  IGFBP-2 heparin binding domain-containing peptide sequence
KRKVGINNPRR

SEQ ID NO: 5745 - protein, 11 aa, Artificial
  IGFBP-2 heparin binding domain-containing peptide sequence
RRKVGINNPRR

SEQ ID NO: 5746 - protein, 11 aa, Artificial
  IGFBP-2 heparin binding domain-containing peptide sequence
HRKVGINNPRR

SEQ ID NO: 5747 - protein, 11 aa, Artificial
  IGFBP-2 heparin binding domain-containing peptide sequence
KHRVGINNPRR

SEQ ID NO: 5748 - protein, 11 aa, Artificial
  IGFBP-2 heparin binding domain-containing peptide sequence
RHRVGINNPRR

SEQ ID NO: 5749 - protein, 11 aa, Artificial
  IGFBP-2 heparin binding domain-containing peptide sequence
HHRVGINNPRR

SEQ ID NO: 5750 - protein, 11 aa, Artificial
  IGFBP-2 heparin binding domain-containing peptide sequence
KKRVGINNPRR

SEQ ID NO: 5751 - protein, 11 aa, Artificial
  IGFBP-2 heparin binding domain-containing peptide sequence
RKRVGINNPRR

SEQ ID NO: 5752 - protein, 11 aa, Artificial
  IGFBP-2 heparin binding domain-containing peptide sequence
HKRVGINNPRR

SEQ ID NO: 5753 - protein, 11 aa, Artificial
  IGFBP-2 heparin binding domain-containing peptide sequence
KRRVGINNPRR

SEQ ID NO: 5754 - protein, 11 aa, Artificial
  IGFBP-2 heparin binding domain-containing peptide sequence
RRRVGINNPRR

SEQ ID NO: 5755 - protein, 11 aa, Artificial
  IGFBP-2 heparin binding domain-containing peptide sequence
HRRVGINNPRR

SEQ ID NO: 5756 - protein, 11 aa, Artificial
  IGFBP-2 heparin binding domain-containing peptide sequence
KHHLGVNNPRR

SEQ ID NO: 5757 - protein, 11 aa, Artificial
  IGFBP-2 heparin binding domain-containing peptide sequence
RHHLGVNNPRR

SEQ ID NO: 5758 - protein, 11 aa, Artificial
  IGFBP-2 heparin binding domain-containing peptide sequence
HHHLGVNNPRR

SEQ ID NO: 5759 - protein, 11 aa, Artificial
  IGFBP-2 heparin binding domain-containing peptide sequence
KKHLGVNNPRR

SEQ ID NO: 5760 - protein, 11 aa, Artificial
  IGFBP-2 heparin binding domain-containing peptide sequence
RKHLGVNNPRR

SEQ ID NO: 5761 - protein, 11 aa, Artificial
  IGFBP-2 heparin binding domain-containing peptide sequence
HKHLGVNNPRR

SEQ ID NO: 5762 - protein, 11 aa, Artificial
  IGFBP-2 heparin binding domain-containing peptide sequence
KRHLGVNNPRR

SEQ ID NO: 5763 - protein, 11 aa, Artificial
  IGFBP-2 heparin binding domain-containing peptide sequence
RRHLGVNNPRR

SEQ ID NO: 5764 - protein, 11 aa, Artificial
  IGFBP-2 heparin binding domain-containing peptide sequence
HRHLGVNNPRR

SEQ ID NO: 5765 - protein, 11 aa, Artificial
  IGFBP-2 heparin binding domain-containing peptide sequence
KHKLGVNNPRR

SEQ ID NO: 5766 - protein, 11 aa, Artificial
  IGFBP-2 heparin binding domain-containing peptide sequence
RHKLGVNNPRR

SEQ ID NO: 5767 - protein, 11 aa, Artificial
  IGFBP-2 heparin binding domain-containing peptide sequence
HHKLGVNNPRR

SEQ ID NO: 5768 - protein, 11 aa, Artificial
  IGFBP-2 heparin binding domain-containing peptide sequence
KKKLGVNNPRR

SEQ ID NO: 5769 - protein, 11 aa, Artificial
  IGFBP-2 heparin binding domain-containing peptide sequence
RKKLGVNNPRR

SEQ ID NO: 5770 - protein, 11 aa, Artificial
  IGFBP-2 heparin binding domain-containing peptide sequence
HKKLGVNNPRR

SEQ ID NO: 5771 - protein, 11 aa, Artificial
  IGFBP-2 heparin binding domain-containing peptide sequence
KRKLGVNNPRR

SEQ ID NO: 5772 - protein, 11 aa, Artificial
  IGFBP-2 heparin binding domain-containing peptide sequence
RRKLGVNNPRR

SEQ ID NO: 5773 - protein, 11 aa, Artificial
  IGFBP-2 heparin binding domain-containing peptide sequence
HRKLGVNNPRR

SEQ ID NO: 5774 - protein, 11 aa, Artificial
  IGFBP-2 heparin binding domain-containing peptide sequence
KHRLGVNNPRR

SEQ ID NO: 5775 - protein, 11 aa, Artificial
  IGFBP-2 heparin binding domain-containing peptide sequence
RHRLGVNNPRR

SEQ ID NO: 5776 - protein, 11 aa, Artificial
  IGFBP-2 heparin binding domain-containing peptide sequence
HHRLGVNNPRR

SEQ ID NO: 5777 - protein, 11 aa, Artificial
  IGFBP-2 heparin binding domain-containing peptide sequence
KKRLGVNNPRR

SEQ ID NO: 5778 - protein, 11 aa, Artificial
  IGFBP-2 heparin binding domain-containing peptide sequence
RKRLGVNNPRR

SEQ ID NO: 5779 - protein, 11 aa, Artificial
  IGFBP-2 heparin binding domain-containing peptide sequence
HKRLGVNNPRR

SEQ ID NO: 5780 - protein, 11 aa, Artificial
  IGFBP-2 heparin binding domain-containing peptide sequence
KRRLGVNNPRR

SEQ ID NO: 5781 - protein, 11 aa, Artificial
  IGFBP-2 heparin binding domain-containing peptide sequence
RRRLGVNNPRR

SEQ ID NO: 5782 - protein, 11 aa, Artificial
  IGFBP-2 heparin binding domain-containing peptide sequence
HRRLGVNNPRR

SEQ ID NO: 5783 - protein, 11 aa, Artificial
  IGFBP-2 heparin binding domain-containing peptide sequence
KHHIGVNNPRR

SEQ ID NO: 5784 - protein, 11 aa, Artificial
  IGFBP-2 heparin binding domain-containing peptide sequence
RHHIGVNNPRR

SEQ ID NO: 5785 - protein, 11 aa, Artificial
  IGFBP-2 heparin binding domain-containing peptide sequence
HHHIGVNNPRR

SEQ ID NO: 5786 - protein, 11 aa, Artificial
  IGFBP-2 heparin binding domain-containing peptide sequence
KKHIGVNNPRR

SEQ ID NO: 5787 - protein, 11 aa, Artificial
  IGFBP-2 heparin binding domain-containing peptide sequence
RKHIGVNNPRR

SEQ ID NO: 5788 - protein, 11 aa, Artificial
  IGFBP-2 heparin binding domain-containing peptide sequence
HKHIGVNNPRR

SEQ ID NO: 5789 - protein, 11 aa, Artificial
  IGFBP-2 heparin binding domain-containing peptide sequence
KRHIGVNNPRR

SEQ ID NO: 5790 - protein, 11 aa, Artificial
  IGFBP-2 heparin binding domain-containing peptide sequence
RRHIGVNNPRR

SEQ ID NO: 5791 - protein, 11 aa, Artificial
  IGFBP-2 heparin binding domain-containing peptide sequence
HRHIGVNNPRR

SEQ ID NO: 5792 - protein, 11 aa, Artificial
  IGFBP-2 heparin binding domain-containing peptide sequence
KHKIGVNNPRR

SEQ ID NO: 5793 - protein, 11 aa, Artificial
  IGFBP-2 heparin binding domain-containing peptide sequence
RHKIGVNNPRR

SEQ ID NO: 5794 - protein, 11 aa, Artificial
  IGFBP-2 heparin binding domain-containing peptide sequence
HHKIGVNNPRR

SEQ ID NO: 5795 - protein, 11 aa, Artificial
  IGFBP-2 heparin binding domain-containing peptide sequence
KKKIGVNNPRR

SEQ ID NO: 5796 - protein, 11 aa, Artificial
  IGFBP-2 heparin binding domain-containing peptide sequence
RKKIGVNNPRR

SEQ ID NO: 5797 - protein, 11 aa, Artificial
  IGFBP-2 heparin binding domain-containing peptide sequence
HKKIGVNNPRR

SEQ ID NO: 5798 - protein, 11 aa, Artificial
  IGFBP-2 heparin binding domain-containing peptide sequence
KRKIGVNNPRR

SEQ ID NO: 5799 - protein, 11 aa, Artificial
  IGFBP-2 heparin binding domain-containing peptide sequence
RRKIGVNNPRR

SEQ ID NO: 5800 - protein, 11 aa, Artificial
  IGFBP-2 heparin binding domain-containing peptide sequence
HRKIGVNNPRR

SEQ ID NO: 5801 - protein, 11 aa, Artificial
  IGFBP-2 heparin binding domain-containing peptide sequence
KHRIGVNNPRR

SEQ ID NO: 5802 - protein, 11 aa, Artificial
  IGFBP-2 heparin binding domain-containing peptide sequence
RHRIGVNNPRR

SEQ ID NO: 5803 - protein, 11 aa, Artificial
  IGFBP-2 heparin binding domain-containing peptide sequence
HHRIGVNNPRR

SEQ ID NO: 5804 - protein, 11 aa, Artificial
  IGFBP-2 heparin binding domain-containing peptide sequence
KKRIGVNNPRR

SEQ ID NO: 5805 - protein, 11 aa, Artificial
  IGFBP-2 heparin binding domain-containing peptide sequence
RKRIGVNNPRR

SEQ ID NO: 5806 - protein, 11 aa, Artificial
  IGFBP-2 heparin binding domain-containing peptide sequence
HKRIGVNNPRR

SEQ ID NO: 5807 - protein, 11 aa, Artificial
  IGFBP-2 heparin binding domain-containing peptide sequence
KRRIGVNNPRR

SEQ ID NO: 5808 - protein, 11 aa, Artificial
  IGFBP-2 heparin binding domain-containing peptide sequence
RRRIGVNNPRR

SEQ ID NO: 5809 - protein, 11 aa, Artificial
  IGFBP-2 heparin binding domain-containing peptide sequence
HRRIGVNNPRR

SEQ ID NO: 5810 - protein, 11 aa, Artificial
  IGFBP-2 heparin binding domain-containing peptide sequence
KHHVGVNNPRR

SEQ ID NO: 5811 - protein, 11 aa, Artificial
  IGFBP-2 heparin binding domain-containing peptide sequence
RHHVGVNNPRR

SEQ ID NO: 5812 - protein, 11 aa, Artificial
  IGFBP-2 heparin binding domain-containing peptide sequence
HHHVGVNNPRR

SEQ ID NO: 5813 - protein, 11 aa, Artificial
  IGFBP-2 heparin binding domain-containing peptide sequence
KKHVGVNNPRR

SEQ ID NO: 5814 - protein, 11 aa, Artificial
  IGFBP-2 heparin binding domain-containing peptide sequence
RKHVGVNNPRR

SEQ ID NO: 5815 - protein, 11 aa, Artificial
  IGFBP-2 heparin binding domain-containing peptide sequence
HKHVGVNNPRR

SEQ ID NO: 5816 - protein, 11 aa, Artificial
  IGFBP-2 heparin binding domain-containing peptide sequence
KRHVGVNNPRR

SEQ ID NO: 5817 - protein, 11 aa, Artificial
  IGFBP-2 heparin binding domain-containing peptide sequence
RRHVGVNNPRR

SEQ ID NO: 5818 - protein, 11 aa, Artificial
  IGFBP-2 heparin binding domain-containing peptide sequence
HRHVGVNNPRR

SEQ ID NO: 5819 - protein, 11 aa, Artificial
  IGFBP-2 heparin binding domain-containing peptide sequence
KHKVGVNNPRR

SEQ ID NO: 5820 - protein, 11 aa, Artificial
  IGFBP-2 heparin binding domain-containing peptide sequence
RHKVGVNNPRR

SEQ ID NO: 5821 - protein, 11 aa, Artificial
  IGFBP-2 heparin binding domain-containing peptide sequence
HHKVGVNNPRR

SEQ ID NO: 5822 - protein, 11 aa, Artificial
  IGFBP-2 heparin binding domain-containing peptide sequence
KKKVGVNNPRR

SEQ ID NO: 5823 - protein, 11 aa, Artificial
  IGFBP-2 heparin binding domain-containing peptide sequence
RKKVGVNNPRR

SEQ ID NO: 5824 - protein, 11 aa, Artificial
  IGFBP-2 heparin binding domain-containing peptide sequence
HKKVGVNNPRR

SEQ ID NO: 5825 - protein, 11 aa, Artificial
  IGFBP-2 heparin binding domain-containing peptide sequence
KRKVGVNNPRR

SEQ ID NO: 5826 - protein, 11 aa, Artificial
  IGFBP-2 heparin binding domain-containing peptide sequence
RRKVGVNNPRR

SEQ ID NO: 5827 - protein, 11 aa, Artificial
  IGFBP-2 heparin binding domain-containing peptide sequence
HRKVGVNNPRR

SEQ ID NO: 5828 - protein, 11 aa, Artificial
  IGFBP-2 heparin binding domain-containing peptide sequence
KHRVGVNNPRR

SEQ ID NO: 5829 - protein, 11 aa, Artificial
  IGFBP-2 heparin binding domain-containing peptide sequence
RHRVGVNNPRR

SEQ ID NO: 5830 - protein, 11 aa, Artificial
  IGFBP-2 heparin binding domain-containing peptide sequence
HHRVGVNNPRR

SEQ ID NO: 5831 - protein, 11 aa, Artificial
  IGFBP-2 heparin binding domain-containing peptide sequence
KKRVGVNNPRR

SEQ ID NO: 5832 - protein, 11 aa, Artificial
  IGFBP-2 heparin binding domain-containing peptide sequence
RKRVGVNNPRR

SEQ ID NO: 5833 - protein, 11 aa, Artificial
  IGFBP-2 heparin binding domain-containing peptide sequence
HKRVGVNNPRR

SEQ ID NO: 5834 - protein, 11 aa, Artificial
  IGFBP-2 heparin binding domain-containing peptide sequence
KRRVGVNNPRR

SEQ ID NO: 5835 - protein, 11 aa, Artificial
  IGFBP-2 heparin binding domain-containing peptide sequence
RRRVGVNNPRR

SEQ ID NO: 5836 - protein, 11 aa, Artificial
  IGFBP-2 heparin binding domain-containing peptide sequence
HRRVGVNNPRR

SEQ ID NO: 5837 - protein, 11 aa, Artificial
  IGFBP-2 heparin binding domain-containing peptide sequence
KHHLGLEEPRH

SEQ ID NO: 5838 - protein, 11 aa, Artificial
  IGFBP-2 heparin binding domain-containing peptide sequence
RHHLGLEEPRH

SEQ ID NO: 5839 - protein, 11 aa, Artificial
  IGFBP-2 heparin binding domain-containing peptide sequence
HHHLGLEEPRH

SEQ ID NO: 5840 - protein, 11 aa, Artificial
  IGFBP-2 heparin binding domain-containing peptide sequence
KKHLGLEEPRH

SEQ ID NO: 5841 - protein, 11 aa, Artificial
  IGFBP-2 heparin binding domain-containing peptide sequence
RKHLGLEEPRH

SEQ ID NO: 5842 - protein, 11 aa, Artificial
  IGFBP-2 heparin binding domain-containing peptide sequence
HKHLGLEEPRH

SEQ ID NO: 5843 - protein, 11 aa, Artificial
  IGFBP-2 heparin binding domain-containing peptide sequence
KRHLGLEEPRH

SEQ ID NO: 5844 - protein, 11 aa, Artificial
  IGFBP-2 heparin binding domain-containing peptide sequence
RRHLGLEEPRH

SEQ ID NO: 5845 - protein, 11 aa, Artificial
  IGFBP-2 heparin binding domain-containing peptide sequence
HRHLGLEEPRH

SEQ ID NO: 5846 - protein, 11 aa, Artificial
  IGFBP-2 heparin binding domain-containing peptide sequence
KHKLGLEEPRH

SEQ ID NO: 5847 - protein, 11 aa, Artificial
  IGFBP-2 heparin binding domain-containing peptide sequence
RHKLGLEEPRH

SEQ ID NO: 5848 - protein, 11 aa, Artificial
  IGFBP-2 heparin binding domain-containing peptide sequence
HHKLGLEEPRH

SEQ ID NO: 5849 - protein, 11 aa, Artificial
  IGFBP-2 heparin binding domain-containing peptide sequence
KKKLGLEEPRH

SEQ ID NO: 5850 - protein, 11 aa, Artificial
  IGFBP-2 heparin binding domain-containing peptide sequence
RKKLGLEEPRH

SEQ ID NO: 5851 - protein, 11 aa, Artificial
  IGFBP-2 heparin binding domain-containing peptide sequence
HKKLGLEEPRH

SEQ ID NO: 5852 - protein, 11 aa, Artificial
  IGFBP-2 heparin binding domain-containing peptide sequence
KRKLGLEEPRH

SEQ ID NO: 5853 - protein, 11 aa, Artificial
  IGFBP-2 heparin binding domain-containing peptide sequence
RRKLGLEEPRH

SEQ ID NO: 5854 - protein, 11 aa, Artificial
  IGFBP-2 heparin binding domain-containing peptide sequence
HRKLGLEEPRH

SEQ ID NO: 5855 - protein, 11 aa, Artificial
  IGFBP-2 heparin binding domain-containing peptide sequence
KHRLGLEEPRH

SEQ ID NO: 5856 - protein, 11 aa, Artificial
  IGFBP-2 heparin binding domain-containing peptide sequence
RHRLGLEEPRH

SEQ ID NO: 5857 - protein, 11 aa, Artificial
  IGFBP-2 heparin binding domain-containing peptide sequence
HHRLGLEEPRH

SEQ ID NO: 5858 - protein, 11 aa, Artificial
  IGFBP-2 heparin binding domain-containing peptide sequence
KKRLGLEEPRH

SEQ ID NO: 5859 - protein, 11 aa, Artificial
  IGFBP-2 heparin binding domain-containing peptide sequence
RKRLGLEEPRH

SEQ ID NO: 5860 - protein, 11 aa, Artificial
  IGFBP-2 heparin binding domain-containing peptide sequence
HKRLGLEEPRH

SEQ ID NO: 5861 - protein, 11 aa, Artificial
  IGFBP-2 heparin binding domain-containing peptide sequence
KRRLGLEEPRH

SEQ ID NO: 5862 - protein, 11 aa, Artificial
  IGFBP-2 heparin binding domain-containing peptide sequence
RRRLGLEEPRH

SEQ ID NO: 5863 - protein, 11 aa, Artificial
  IGFBP-2 heparin binding domain-containing peptide sequence
HRRLGLEEPRH

SEQ ID NO: 5864 - protein, 11 aa, Artificial
  IGFBP-2 heparin binding domain-containing peptide sequence
KHHIGLEEPRH

SEQ ID NO: 5865 - protein, 11 aa, Artificial
  IGFBP-2 heparin binding domain-containing peptide sequence
RHHIGLEEPRH

SEQ ID NO: 5866 - protein, 11 aa, Artificial
  IGFBP-2 heparin binding domain-containing peptide sequence
HHHIGLEEPRH

SEQ ID NO: 5867 - protein, 11 aa, Artificial
  IGFBP-2 heparin binding domain-containing peptide sequence
KKHIGLEEPRH

SEQ ID NO: 5868 - protein, 11 aa, Artificial
  IGFBP-2 heparin binding domain-containing peptide sequence
RKHIGLEEPRH

SEQ ID NO: 5869 - protein, 11 aa, Artificial
  IGFBP-2 heparin binding domain-containing peptide sequence
HKHIGLEEPRH

SEQ ID NO: 5870 - protein, 11 aa, Artificial
  IGFBP-2 heparin binding domain-containing peptide sequence
KRHIGLEEPRH

SEQ ID NO: 5871 - protein, 11 aa, Artificial
  IGFBP-2 heparin binding domain-containing peptide sequence
RRHIGLEEPRH

SEQ ID NO: 5872 - protein, 11 aa, Artificial
  IGFBP-2 heparin binding domain-containing peptide sequence
HRHIGLEEPRH

SEQ ID NO: 5873 - protein, 11 aa, Artificial
  IGFBP-2 heparin binding domain-containing peptide sequence
KHKIGLEEPRH

SEQ ID NO: 5874 - protein, 11 aa, Artificial
  IGFBP-2 heparin binding domain-containing peptide sequence
RHKIGLEEPRH

SEQ ID NO: 5875 - protein, 11 aa, Artificial
  IGFBP-2 heparin binding domain-containing peptide sequence
HHKIGLEEPRH

SEQ ID NO: 5876 - protein, 11 aa, Artificial
  IGFBP-2 heparin binding domain-containing peptide sequence
KKKIGLEEPRH

SEQ ID NO: 5877 - protein, 11 aa, Artificial
  IGFBP-2 heparin binding domain-containing peptide sequence
RKKIGLEEPRH

SEQ ID NO: 5878 - protein, 11 aa, Artificial
  IGFBP-2 heparin binding domain-containing peptide sequence
HKKIGLEEPRH

SEQ ID NO: 5879 - protein, 11 aa, Artificial
  IGFBP-2 heparin binding domain-containing peptide sequence
KRKIGLEEPRH

SEQ ID NO: 5880 - protein, 11 aa, Artificial
  IGFBP-2 heparin binding domain-containing peptide sequence
RRKIGLEEPRH

SEQ ID NO: 5881 - protein, 11 aa, Artificial
  IGFBP-2 heparin binding domain-containing peptide sequence
HRKIGLEEPRH

SEQ ID NO: 5882 - protein, 11 aa, Artificial
  IGFBP-2 heparin binding domain-containing peptide sequence
KHRIGLEEPRH

SEQ ID NO: 5883 - protein, 11 aa, Artificial
  IGFBP-2 heparin binding domain-containing peptide sequence
RHRIGLEEPRH

SEQ ID NO: 5884 - protein, 11 aa, Artificial
  IGFBP-2 heparin binding domain-containing peptide sequence
HHRIGLEEPRH

SEQ ID NO: 5885 - protein, 11 aa, Artificial
  IGFBP-2 heparin binding domain-containing peptide sequence
KKRIGLEEPRH

SEQ ID NO: 5886 - protein, 11 aa, Artificial
  IGFBP-2 heparin binding domain-containing peptide sequence
RKRIGLEEPRH

SEQ ID NO: 5887 - protein, 11 aa, Artificial
  IGFBP-2 heparin binding domain-containing peptide sequence
HKRIGLEEPRH

SEQ ID NO: 5888 - protein, 11 aa, Artificial
  IGFBP-2 heparin binding domain-containing peptide sequence
KRRIGLEEPRH

SEQ ID NO: 5889 - protein, 11 aa, Artificial
  IGFBP-2 heparin binding domain-containing peptide sequence
RRRIGLEEPRH

SEQ ID NO: 5890 - protein, 11 aa, Artificial
  IGFBP-2 heparin binding domain-containing peptide sequence
HRRIGLEEPRH

SEQ ID NO: 5891 - protein, 11 aa, Artificial
  IGFBP-2 heparin binding domain-containing peptide sequence
KHHVGLEEPRH

SEQ ID NO: 5892 - protein, 11 aa, Artificial
  IGFBP-2 heparin binding domain-containing peptide sequence
RHHVGLEEPRH

SEQ ID NO: 5893 - protein, 11 aa, Artificial
  IGFBP-2 heparin binding domain-containing peptide sequence
HHHVGLEEPRH

SEQ ID NO: 5894 - protein, 11 aa, Artificial
  IGFBP-2 heparin binding domain-containing peptide sequence
KKHVGLEEPRH

SEQ ID NO: 5895 - protein, 11 aa, Artificial
  IGFBP-2 heparin binding domain-containing peptide sequence
RKHVGLEEPRH

SEQ ID NO: 5896 - protein, 11 aa, Artificial
  IGFBP-2 heparin binding domain-containing peptide sequence
HKHVGLEEPRH

SEQ ID NO: 5897 - protein, 11 aa, Artificial
  IGFBP-2 heparin binding domain-containing peptide sequence
KRHVGLEEPRH

SEQ ID NO: 5898 - protein, 11 aa, Artificial
  IGFBP-2 heparin binding domain-containing peptide sequence
RRHVGLEEPRH

SEQ ID NO: 5899 - protein, 11 aa, Artificial
  IGFBP-2 heparin binding domain-containing peptide sequence
HRHVGLEEPRH

SEQ ID NO: 5900 - protein, 11 aa, Artificial
  IGFBP-2 heparin binding domain-containing peptide sequence
KHKVGLEEPRH

SEQ ID NO: 5901 - protein, 11 aa, Artificial
  IGFBP-2 heparin binding domain-containing peptide sequence
RHKVGLEEPRH

SEQ ID NO: 5902 - protein, 11 aa, Artificial
  IGFBP-2 heparin binding domain-containing peptide sequence
HHKVGLEEPRH

SEQ ID NO: 5903 - protein, 11 aa, Artificial
  IGFBP-2 heparin binding domain-containing peptide sequence
KKKVGLEEPRH

SEQ ID NO: 5904 - protein, 11 aa, Artificial
  IGFBP-2 heparin binding domain-containing peptide sequence
RKKVGLEEPRH

SEQ ID NO: 5905 - protein, 11 aa, Artificial
  IGFBP-2 heparin binding domain-containing peptide sequence
HKKVGLEEPRH

SEQ ID NO: 5906 - protein, 11 aa, Artificial
  IGFBP-2 heparin binding domain-containing peptide sequence
KRKVGLEEPRH

SEQ ID NO: 5907 - protein, 11 aa, Artificial
  IGFBP-2 heparin binding domain-containing peptide sequence
RRKVGLEEPRH

SEQ ID NO: 5908 - protein, 11 aa, Artificial
  IGFBP-2 heparin binding domain-containing peptide sequence
HRKVGLEEPRH

SEQ ID NO: 5909 - protein, 11 aa, Artificial
  IGFBP-2 heparin binding domain-containing peptide sequence
KHRVGLEEPRH

SEQ ID NO: 5910 - protein, 11 aa, Artificial
  IGFBP-2 heparin binding domain-containing peptide sequence
RHRVGLEEPRH

SEQ ID NO: 5911 - protein, 11 aa, Artificial
  IGFBP-2 heparin binding domain-containing peptide sequence
HHRVGLEEPRH

SEQ ID NO: 5912 - protein, 11 aa, Artificial
  IGFBP-2 heparin binding domain-containing peptide sequence
KKRVGLEEPRH

SEQ ID NO: 5913 - protein, 11 aa, Artificial
  IGFBP-2 heparin binding domain-containing peptide sequence
RKRVGLEEPRH

SEQ ID NO: 5914 - protein, 11 aa, Artificial
  IGFBP-2 heparin binding domain-containing peptide sequence
HKRVGLEEPRH

SEQ ID NO: 5915 - protein, 11 aa, Artificial
  IGFBP-2 heparin binding domain-containing peptide sequence
KRRVGLEEPRH

SEQ ID NO: 5916 - protein, 11 aa, Artificial
  IGFBP-2 heparin binding domain-containing peptide sequence
RRRVGLEEPRH

SEQ ID NO: 5917 - protein, 11 aa, Artificial
  IGFBP-2 heparin binding domain-containing peptide sequence
HRRVGLEEPRH

SEQ ID NO: 5918 - protein, 11 aa, Artificial
  IGFBP-2 heparin binding domain-containing peptide sequence
KHHLGIEEPRH

SEQ ID NO: 5919 - protein, 11 aa, Artificial
  IGFBP-2 heparin binding domain-containing peptide sequence
RHHLGIEEPRH

SEQ ID NO: 5920 - protein, 11 aa, Artificial
  IGFBP-2 heparin binding domain-containing peptide sequence
HHHLGIEEPRH

SEQ ID NO: 5921 - protein, 11 aa, Artificial
  IGFBP-2 heparin binding domain-containing peptide sequence
KKHLGIEEPRH

SEQ ID NO: 5922 - protein, 11 aa, Artificial
  IGFBP-2 heparin binding domain-containing peptide sequence
RKHLGIEEPRH

SEQ ID NO: 5923 - protein, 11 aa, Artificial
  IGFBP-2 heparin binding domain-containing peptide sequence
HKHLGIEEPRH

SEQ ID NO: 5924 - protein, 11 aa, Artificial
  IGFBP-2 heparin binding domain-containing peptide sequence
KRHLGIEEPRH

SEQ ID NO: 5925 - protein, 11 aa, Artificial
  IGFBP-2 heparin binding domain-containing peptide sequence
RRHLGIEEPRH

SEQ ID NO: 5926 - protein, 11 aa, Artificial
  IGFBP-2 heparin binding domain-containing peptide sequence
HRHLGIEEPRH

SEQ ID NO: 5927 - protein, 11 aa, Artificial
  IGFBP-2 heparin binding domain-containing peptide sequence
KHKLGIEEPRH

SEQ ID NO: 5928 - protein, 11 aa, Artificial
  IGFBP-2 heparin binding domain-containing peptide sequence
RHKLGIEEPRH

SEQ ID NO: 5929 - protein, 11 aa, Artificial
  IGFBP-2 heparin binding domain-containing peptide sequence
HHKLGIEEPRH

SEQ ID NO: 5930 - protein, 11 aa, Artificial
  IGFBP-2 heparin binding domain-containing peptide sequence
KKKLGIEEPRH

SEQ ID NO: 5931 - protein, 11 aa, Artificial
  IGFBP-2 heparin binding domain-containing peptide sequence
RKKLGIEEPRH

SEQ ID NO: 5932 - protein, 11 aa, Artificial
  IGFBP-2 heparin binding domain-containing peptide sequence
HKKLGIEEPRH

SEQ ID NO: 5933 - protein, 11 aa, Artificial
  IGFBP-2 heparin binding domain-containing peptide sequence
KRKLGIEEPRH

SEQ ID NO: 5934 - protein, 11 aa, Artificial
  IGFBP-2 heparin binding domain-containing peptide sequence
RRKLGIEEPRH

SEQ ID NO: 5935 - protein, 11 aa, Artificial
  IGFBP-2 heparin binding domain-containing peptide sequence
HRKLGIEEPRH

SEQ ID NO: 5936 - protein, 11 aa, Artificial
  IGFBP-2 heparin binding domain-containing peptide sequence
KHRLGIEEPRH

SEQ ID NO: 5937 - protein, 11 aa, Artificial
  IGFBP-2 heparin binding domain-containing peptide sequence
RHRLGIEEPRH

SEQ ID NO: 5938 - protein, 11 aa, Artificial
  IGFBP-2 heparin binding domain-containing peptide sequence
HHRLGIEEPRH

SEQ ID NO: 5939 - protein, 11 aa, Artificial
  IGFBP-2 heparin binding domain-containing peptide sequence
KKRLGIEEPRH

SEQ ID NO: 5940 - protein, 11 aa, Artificial
  IGFBP-2 heparin binding domain-containing peptide sequence
RKRLGIEEPRH

SEQ ID NO: 5941 - protein, 11 aa, Artificial
  IGFBP-2 heparin binding domain-containing peptide sequence
HKRLGIEEPRH

SEQ ID NO: 5942 - protein, 11 aa, Artificial
  IGFBP-2 heparin binding domain-containing peptide sequence
KRRLGIEEPRH

SEQ ID NO: 5943 - protein, 11 aa, Artificial
  IGFBP-2 heparin binding domain-containing peptide sequence
RRRLGIEEPRH

SEQ ID NO: 5944 - protein, 11 aa, Artificial
  IGFBP-2 heparin binding domain-containing peptide sequence
HRRLGIEEPRH

SEQ ID NO: 5945 - protein, 11 aa, Artificial
  IGFBP-2 heparin binding domain-containing peptide sequence
KHHIGIEEPRH

SEQ ID NO: 5946 - protein, 11 aa, Artificial
  IGFBP-2 heparin binding domain-containing peptide sequence
RHHIGIEEPRH

SEQ ID NO: 5947 - protein, 11 aa, Artificial
  IGFBP-2 heparin binding domain-containing peptide sequence
HHHIGIEEPRH

SEQ ID NO: 5948 - protein, 11 aa, Artificial
  IGFBP-2 heparin binding domain-containing peptide sequence
KKHIGIEEPRH

SEQ ID NO: 5949 - protein, 11 aa, Artificial
  IGFBP-2 heparin binding domain-containing peptide sequence
RKHIGIEEPRH

SEQ ID NO: 5950 - protein, 11 aa, Artificial
  IGFBP-2 heparin binding domain-containing peptide sequence
HKHIGIEEPRH

SEQ ID NO: 5951 - protein, 11 aa, Artificial
  IGFBP-2 heparin binding domain-containing peptide sequence
KRHIGIEEPRH

SEQ ID NO: 5952 - protein, 11 aa, Artificial
  IGFBP-2 heparin binding domain-containing peptide sequence
RRHIGIEEPRH

SEQ ID NO: 5953 - protein, 11 aa, Artificial
  IGFBP-2 heparin binding domain-containing peptide sequence
HRHIGIEEPRH

SEQ ID NO: 5954 - protein, 11 aa, Artificial
  IGFBP-2 heparin binding domain-containing peptide sequence
KHKIGIEEPRH

SEQ ID NO: 5955 - protein, 11 aa, Artificial
  IGFBP-2 heparin binding domain-containing peptide sequence
RHKIGIEEPRH

SEQ ID NO: 5956 - protein, 11 aa, Artificial
  IGFBP-2 heparin binding domain-containing peptide sequence
HHKIGIEEPRH

SEQ ID NO: 5957 - protein, 11 aa, Artificial
  IGFBP-2 heparin binding domain-containing peptide sequence
KKKIGIEEPRH

SEQ ID NO: 5958 - protein, 11 aa, Artificial
  IGFBP-2 heparin binding domain-containing peptide sequence
RKKIGIEEPRH

SEQ ID NO: 5959 - protein, 11 aa, Artificial
  IGFBP-2 heparin binding domain-containing peptide sequence
HKKIGIEEPRH

SEQ ID NO: 5960 - protein, 11 aa, Artificial
  IGFBP-2 heparin binding domain-containing peptide sequence
KRKIGIEEPRH

SEQ ID NO: 5961 - protein, 11 aa, Artificial
  IGFBP-2 heparin binding domain-containing peptide sequence
RRKIGIEEPRH

SEQ ID NO: 5962 - protein, 11 aa, Artificial
  IGFBP-2 heparin binding domain-containing peptide sequence
HRKIGIEEPRH

SEQ ID NO: 5963 - protein, 11 aa, Artificial
  IGFBP-2 heparin binding domain-containing peptide sequence
KHRIGIEEPRH

SEQ ID NO: 5964 - protein, 11 aa, Artificial
  IGFBP-2 heparin binding domain-containing peptide sequence
RHRIGIEEPRH

SEQ ID NO: 5965 - protein, 11 aa, Artificial
  IGFBP-2 heparin binding domain-containing peptide sequence
HHRIGIEEPRH

SEQ ID NO: 5966 - protein, 11 aa, Artificial
  IGFBP-2 heparin binding domain-containing peptide sequence
KKRIGIEEPRH

SEQ ID NO: 5967 - protein, 11 aa, Artificial
  IGFBP-2 heparin binding domain-containing peptide sequence
RKRIGIEEPRH

SEQ ID NO: 5968 - protein, 11 aa, Artificial
  IGFBP-2 heparin binding domain-containing peptide sequence
HKRIGIEEPRH

SEQ ID NO: 5969 - protein, 11 aa, Artificial
  IGFBP-2 heparin binding domain-containing peptide sequence
KRRIGIEEPRH

SEQ ID NO: 5970 - protein, 11 aa, Artificial
  IGFBP-2 heparin binding domain-containing peptide sequence
RRRIGIEEPRH

SEQ ID NO: 5971 - protein, 11 aa, Artificial
  IGFBP-2 heparin binding domain-containing peptide sequence
HRRIGIEEPRH

SEQ ID NO: 5972 - protein, 11 aa, Artificial
  IGFBP-2 heparin binding domain-containing peptide sequence
KHHVGIEEPRH

SEQ ID NO: 5973 - protein, 11 aa, Artificial
  IGFBP-2 heparin binding domain-containing peptide sequence
RHHVGIEEPRH

SEQ ID NO: 5974 - protein, 11 aa, Artificial
  IGFBP-2 heparin binding domain-containing peptide sequence
HHHVGIEEPRH

SEQ ID NO: 5975 - protein, 11 aa, Artificial
  IGFBP-2 heparin binding domain-containing peptide sequence
KKHVGIEEPRH

SEQ ID NO: 5976 - protein, 11 aa, Artificial
  IGFBP-2 heparin binding domain-containing peptide sequence
RKHVGIEEPRH

SEQ ID NO: 5977 - protein, 11 aa, Artificial
  IGFBP-2 heparin binding domain-containing peptide sequence
HKHVGIEEPRH

SEQ ID NO: 5978 - protein, 11 aa, Artificial
  IGFBP-2 heparin binding domain-containing peptide sequence
KRHVGIEEPRH

SEQ ID NO: 5979 - protein, 11 aa, Artificial
  IGFBP-2 heparin binding domain-containing peptide sequence
RRHVGIEEPRH

SEQ ID NO: 5980 - protein, 11 aa, Artificial
  IGFBP-2 heparin binding domain-containing peptide sequence
HRHVGIEEPRH

SEQ ID NO: 5981 - protein, 11 aa, Artificial
  IGFBP-2 heparin binding domain-containing peptide sequence
KHKVGIEEPRH

SEQ ID NO: 5982 - protein, 11 aa, Artificial
  IGFBP-2 heparin binding domain-containing peptide sequence
RHKVGIEEPRH

SEQ ID NO: 5983 - protein, 11 aa, Artificial
  IGFBP-2 heparin binding domain-containing peptide sequence
HHKVGIEEPRH

SEQ ID NO: 5984 - protein, 11 aa, Artificial
  IGFBP-2 heparin binding domain-containing peptide sequence
KKKVGIEEPRH

SEQ ID NO: 5985 - protein, 11 aa, Artificial
  IGFBP-2 heparin binding domain-containing peptide sequence
RKKVGIEEPRH

SEQ ID NO: 5986 - protein, 11 aa, Artificial
  IGFBP-2 heparin binding domain-containing peptide sequence
HKKVGIEEPRH

SEQ ID NO: 5987 - protein, 11 aa, Artificial
  IGFBP-2 heparin binding domain-containing peptide sequence
KRKVGIEEPRH

SEQ ID NO: 5988 - protein, 11 aa, Artificial
  IGFBP-2 heparin binding domain-containing peptide sequence
RRKVGIEEPRH

SEQ ID NO: 5989 - protein, 11 aa, Artificial
  IGFBP-2 heparin binding domain-containing peptide sequence
HRKVGIEEPRH

SEQ ID NO: 5990 - protein, 11 aa, Artificial
  IGFBP-2 heparin binding domain-containing peptide sequence
KHRVGIEEPRH

SEQ ID NO: 5991 - protein, 11 aa, Artificial
  IGFBP-2 heparin binding domain-containing peptide sequence
RHRVGIEEPRH

SEQ ID NO: 5992 - protein, 11 aa, Artificial
  IGFBP-2 heparin binding domain-containing peptide sequence
HHRVGIEEPRH

SEQ ID NO: 5993 - protein, 11 aa, Artificial
  IGFBP-2 heparin binding domain-containing peptide sequence
KKRVGIEEPRH

SEQ ID NO: 5994 - protein, 11 aa, Artificial
  IGFBP-2 heparin binding domain-containing peptide sequence
RKRVGIEEPRH

SEQ ID NO: 5995 - protein, 11 aa, Artificial
  IGFBP-2 heparin binding domain-containing peptide sequence
HKRVGIEEPRH

SEQ ID NO: 5996 - protein, 11 aa, Artificial
  IGFBP-2 heparin binding domain-containing peptide sequence
KRRVGIEEPRH

SEQ ID NO: 5997 - protein, 11 aa, Artificial
  IGFBP-2 heparin binding domain-containing peptide sequence
RRRVGIEEPRH

SEQ ID NO: 5998 - protein, 11 aa, Artificial
  IGFBP-2 heparin binding domain-containing peptide sequence
HRRVGIEEPRH

SEQ ID NO: 5999 - protein, 11 aa, Artificial
  IGFBP-2 heparin binding domain-containing peptide sequence
KHHLGVEEPRH

SEQ ID NO: 6000 - protein, 11 aa, Artificial
  IGFBP-2 heparin binding domain-containing peptide sequence
RHHLGVEEPRH

SEQ ID NO: 6001 - protein, 11 aa, Artificial
  IGFBP-2 heparin binding domain-containing peptide sequence
HHHLGVEEPRH

SEQ ID NO: 6002 - protein, 11 aa, Artificial
  IGFBP-2 heparin binding domain-containing peptide sequence
KKHLGVEEPRH

SEQ ID NO: 6003 - protein, 11 aa, Artificial
  IGFBP-2 heparin binding domain-containing peptide sequence
RKHLGVEEPRH

SEQ ID NO: 6004 - protein, 11 aa, Artificial
  IGFBP-2 heparin binding domain-containing peptide sequence
HKHLGVEEPRH

SEQ ID NO: 6005 - protein, 11 aa, Artificial
  IGFBP-2 heparin binding domain-containing peptide sequence
KRHLGVEEPRH

SEQ ID NO: 6006 - protein, 11 aa, Artificial
  IGFBP-2 heparin binding domain-containing peptide sequence
RRHLGVEEPRH

SEQ ID NO: 6007 - protein, 11 aa, Artificial
  IGFBP-2 heparin binding domain-containing peptide sequence
HRHLGVEEPRH

SEQ ID NO: 6008 - protein, 11 aa, Artificial
  IGFBP-2 heparin binding domain-containing peptide sequence
KHKLGVEEPRH

SEQ ID NO: 6009 - protein, 11 aa, Artificial
  IGFBP-2 heparin binding domain-containing peptide sequence
RHKLGVEEPRH

SEQ ID NO: 6010 - protein, 11 aa, Artificial
  IGFBP-2 heparin binding domain-containing peptide sequence
HHKLGVEEPRH

SEQ ID NO: 6011 - protein, 11 aa, Artificial
  IGFBP-2 heparin binding domain-containing peptide sequence
KKKLGVEEPRH

SEQ ID NO: 6012 - protein, 11 aa, Artificial
  IGFBP-2 heparin binding domain-containing peptide sequence
RKKLGVEEPRH

SEQ ID NO: 6013 - protein, 11 aa, Artificial
  IGFBP-2 heparin binding domain-containing peptide sequence
HKKLGVEEPRH

SEQ ID NO: 6014 - protein, 11 aa, Artificial
  IGFBP-2 heparin binding domain-containing peptide sequence
KRKLGVEEPRH

SEQ ID NO: 6015 - protein, 11 aa, Artificial
  IGFBP-2 heparin binding domain-containing peptide sequence
RRKLGVEEPRH

SEQ ID NO: 6016 - protein, 11 aa, Artificial
  IGFBP-2 heparin binding domain-containing peptide sequence
HRKLGVEEPRH

SEQ ID NO: 6017 - protein, 11 aa, Artificial
  IGFBP-2 heparin binding domain-containing peptide sequence
KHRLGVEEPRH

SEQ ID NO: 6018 - protein, 11 aa, Artificial
  IGFBP-2 heparin binding domain-containing peptide sequence
RHRLGVEEPRH

SEQ ID NO: 6019 - protein, 11 aa, Artificial
  IGFBP-2 heparin binding domain-containing peptide sequence
HHRLGVEEPRH

SEQ ID NO: 6020 - protein, 11 aa, Artificial
  IGFBP-2 heparin binding domain-containing peptide sequence
KKRLGVEEPRH

SEQ ID NO: 6021 - protein, 11 aa, Artificial
  IGFBP-2 heparin binding domain-containing peptide sequence
RKRLGVEEPRH

SEQ ID NO: 6022 - protein, 11 aa, Artificial
  IGFBP-2 heparin binding domain-containing peptide sequence
HKRLGVEEPRH

SEQ ID NO: 6023 - protein, 11 aa, Artificial
  IGFBP-2 heparin binding domain-containing peptide sequence
KRRLGVEEPRH

SEQ ID NO: 6024 - protein, 11 aa, Artificial
  IGFBP-2 heparin binding domain-containing peptide sequence
RRRLGVEEPRH

SEQ ID NO: 6025 - protein, 11 aa, Artificial
  IGFBP-2 heparin binding domain-containing peptide sequence
HRRLGVEEPRH

SEQ ID NO: 6026 - protein, 11 aa, Artificial
  IGFBP-2 heparin binding domain-containing peptide sequence
KHHIGVEEPRH

SEQ ID NO: 6027 - protein, 11 aa, Artificial
  IGFBP-2 heparin binding domain-containing peptide sequence
RHHIGVEEPRH

SEQ ID NO: 6028 - protein, 11 aa, Artificial
  IGFBP-2 heparin binding domain-containing peptide sequence
HHHIGVEEPRH

SEQ ID NO: 6029 - protein, 11 aa, Artificial
  IGFBP-2 heparin binding domain-containing peptide sequence
KKHIGVEEPRH

SEQ ID NO: 6030 - protein, 11 aa, Artificial
  IGFBP-2 heparin binding domain-containing peptide sequence
RKHIGVEEPRH

SEQ ID NO: 6031 - protein, 11 aa, Artificial
  IGFBP-2 heparin binding domain-containing peptide sequence
HKHIGVEEPRH

SEQ ID NO: 6032 - protein, 11 aa, Artificial
  IGFBP-2 heparin binding domain-containing peptide sequence
KRHIGVEEPRH

SEQ ID NO: 6033 - protein, 11 aa, Artificial
  IGFBP-2 heparin binding domain-containing peptide sequence
RRHIGVEEPRH

SEQ ID NO: 6034 - protein, 11 aa, Artificial
  IGFBP-2 heparin binding domain-containing peptide sequence
HRHIGVEEPRH

SEQ ID NO: 6035 - protein, 11 aa, Artificial
  IGFBP-2 heparin binding domain-containing peptide sequence
KHKIGVEEPRH

SEQ ID NO: 6036 - protein, 11 aa, Artificial
  IGFBP-2 heparin binding domain-containing peptide sequence
RHKIGVEEPRH

SEQ ID NO: 6037 - protein, 11 aa, Artificial
  IGFBP-2 heparin binding domain-containing peptide sequence
HHKIGVEEPRH

SEQ ID NO: 6038 - protein, 11 aa, Artificial
  IGFBP-2 heparin binding domain-containing peptide sequence
KKKIGVEEPRH

SEQ ID NO: 6039 - protein, 11 aa, Artificial
  IGFBP-2 heparin binding domain-containing peptide sequence
RKKIGVEEPRH

SEQ ID NO: 6040 - protein, 11 aa, Artificial
  IGFBP-2 heparin binding domain-containing peptide sequence
HKKIGVEEPRH

SEQ ID NO: 6041 - protein, 11 aa, Artificial
  IGFBP-2 heparin binding domain-containing peptide sequence
KRKIGVEEPRH

SEQ ID NO: 6042 - protein, 11 aa, Artificial
  IGFBP-2 heparin binding domain-containing peptide sequence
RRKIGVEEPRH

SEQ ID NO: 6043 - protein, 11 aa, Artificial
  IGFBP-2 heparin binding domain-containing peptide sequence
HRKIGVEEPRH

SEQ ID NO: 6044 - protein, 11 aa, Artificial
  IGFBP-2 heparin binding domain-containing peptide sequence
KHRIGVEEPRH

SEQ ID NO: 6045 - protein, 11 aa, Artificial
  IGFBP-2 heparin binding domain-containing peptide sequence
RHRIGVEEPRH

SEQ ID NO: 6046 - protein, 11 aa, Artificial
  IGFBP-2 heparin binding domain-containing peptide sequence
HHRIGVEEPRH

SEQ ID NO: 6047 - protein, 11 aa, Artificial
  IGFBP-2 heparin binding domain-containing peptide sequence
KKRIGVEEPRH

SEQ ID NO: 6048 - protein, 11 aa, Artificial
  IGFBP-2 heparin binding domain-containing peptide sequence
RKRIGVEEPRH

SEQ ID NO: 6049 - protein, 11 aa, Artificial
  IGFBP-2 heparin binding domain-containing peptide sequence
HKRIGVEEPRH

SEQ ID NO: 6050 - protein, 11 aa, Artificial
  IGFBP-2 heparin binding domain-containing peptide sequence
KRRIGVEEPRH

SEQ ID NO: 6051 - protein, 11 aa, Artificial
  IGFBP-2 heparin binding domain-containing peptide sequence
RRRIGVEEPRH

SEQ ID NO: 6052 - protein, 11 aa, Artificial
  IGFBP-2 heparin binding domain-containing peptide sequence
HRRIGVEEPRH

SEQ ID NO: 6053 - protein, 11 aa, Artificial
  IGFBP-2 heparin binding domain-containing peptide sequence
KHHVGVEEPRH

SEQ ID NO: 6054 - protein, 11 aa, Artificial
  IGFBP-2 heparin binding domain-containing peptide sequence
RHHVGVEEPRH

SEQ ID NO: 6055 - protein, 11 aa, Artificial
  IGFBP-2 heparin binding domain-containing peptide sequence
HHHVGVEEPRH

SEQ ID NO: 6056 - protein, 11 aa, Artificial
  IGFBP-2 heparin binding domain-containing peptide sequence
KKHVGVEEPRH

SEQ ID NO: 6057 - protein, 11 aa, Artificial
  IGFBP-2 heparin binding domain-containing peptide sequence
RKHVGVEEPRH

SEQ ID NO: 6058 - protein, 11 aa, Artificial
  IGFBP-2 heparin binding domain-containing peptide sequence
HKHVGVEEPRH

SEQ ID NO: 6059 - protein, 11 aa, Artificial
  IGFBP-2 heparin binding domain-containing peptide sequence
KRHVGVEEPRH

SEQ ID NO: 6060 - protein, 11 aa, Artificial
  IGFBP-2 heparin binding domain-containing peptide sequence
RRHVGVEEPRH

SEQ ID NO: 6061 - protein, 11 aa, Artificial
  IGFBP-2 heparin binding domain-containing peptide sequence
HRHVGVEEPRH

SEQ ID NO: 6062 - protein, 11 aa, Artificial
  IGFBP-2 heparin binding domain-containing peptide sequence
KHKVGVEEPRH

SEQ ID NO: 6063 - protein, 11 aa, Artificial
  IGFBP-2 heparin binding domain-containing peptide sequence
RHKVGVEEPRH

SEQ ID NO: 6064 - protein, 11 aa, Artificial
  IGFBP-2 heparin binding domain-containing peptide sequence
HHKVGVEEPRH

SEQ ID NO: 6065 - protein, 11 aa, Artificial
  IGFBP-2 heparin binding domain-containing peptide sequence
KKKVGVEEPRH

SEQ ID NO: 6066 - protein, 11 aa, Artificial
  IGFBP-2 heparin binding domain-containing peptide sequence
RKKVGVEEPRH

SEQ ID NO: 6067 - protein, 11 aa, Artificial
  IGFBP-2 heparin binding domain-containing peptide sequence
HKKVGVEEPRH

SEQ ID NO: 6068 - protein, 11 aa, Artificial
  IGFBP-2 heparin binding domain-containing peptide sequence
KRKVGVEEPRH

SEQ ID NO: 6069 - protein, 11 aa, Artificial
  IGFBP-2 heparin binding domain-containing peptide sequence
RRKVGVEEPRH

SEQ ID NO: 6070 - protein, 11 aa, Artificial
  IGFBP-2 heparin binding domain-containing peptide sequence
HRKVGVEEPRH

SEQ ID NO: 6071 - protein, 11 aa, Artificial
  IGFBP-2 heparin binding domain-containing peptide sequence
KHRVGVEEPRH

SEQ ID NO: 6072 - protein, 11 aa, Artificial
  IGFBP-2 heparin binding domain-containing peptide sequence
RHRVGVEEPRH

SEQ ID NO: 6073 - protein, 11 aa, Artificial
  IGFBP-2 heparin binding domain-containing peptide sequence
HHRVGVEEPRH

SEQ ID NO: 6074 - protein, 11 aa, Artificial
  IGFBP-2 heparin binding domain-containing peptide sequence
KKRVGVEEPRH

SEQ ID NO: 6075 - protein, 11 aa, Artificial
  IGFBP-2 heparin binding domain-containing peptide sequence
RKRVGVEEPRH

SEQ ID NO: 6076 - protein, 11 aa, Artificial
  IGFBP-2 heparin binding domain-containing peptide sequence
HKRVGVEEPRH

SEQ ID NO: 6077 - protein, 11 aa, Artificial
  IGFBP-2 heparin binding domain-containing peptide sequence
KRRVGVEEPRH

SEQ ID NO: 6078 - protein, 11 aa, Artificial
  IGFBP-2 heparin binding domain-containing peptide sequence
RRRVGVEEPRH

SEQ ID NO: 6079 - protein, 11 aa, Artificial
  IGFBP-2 heparin binding domain-containing peptide sequence
HRRVGVEEPRH

SEQ ID NO: 6080 - protein, 11 aa, Artificial
  IGFBP-2 heparin binding domain-containing peptide sequence
KHHLGLNEPRH

SEQ ID NO: 6081 - protein, 11 aa, Artificial
  IGFBP-2 heparin binding domain-containing peptide sequence
RHHLGLNEPRH

SEQ ID NO: 6082 - protein, 11 aa, Artificial
  IGFBP-2 heparin binding domain-containing peptide sequence
HHHLGLNEPRH

SEQ ID NO: 6083 - protein, 11 aa, Artificial
  IGFBP-2 heparin binding domain-containing peptide sequence
KKHLGLNEPRH

SEQ ID NO: 6084 - protein, 11 aa, Artificial
  IGFBP-2 heparin binding domain-containing peptide sequence
RKHLGLNEPRH

SEQ ID NO: 6085 - protein, 11 aa, Artificial
  IGFBP-2 heparin binding domain-containing peptide sequence
HKHLGLNEPRH

SEQ ID NO: 6086 - protein, 11 aa, Artificial
  IGFBP-2 heparin binding domain-containing peptide sequence
KRHLGLNEPRH

SEQ ID NO: 6087 - protein, 11 aa, Artificial
  IGFBP-2 heparin binding domain-containing peptide sequence
RRHLGLNEPRH

SEQ ID NO: 6088 - protein, 11 aa, Artificial
  IGFBP-2 heparin binding domain-containing peptide sequence
HRHLGLNEPRH

SEQ ID NO: 6089 - protein, 11 aa, Artificial
  IGFBP-2 heparin binding domain-containing peptide sequence
KHKLGLNEPRH

SEQ ID NO: 6090 - protein, 11 aa, Artificial
  IGFBP-2 heparin binding domain-containing peptide sequence
RHKLGLNEPRH

SEQ ID NO: 6091 - protein, 11 aa, Artificial
  IGFBP-2 heparin binding domain-containing peptide sequence
HHKLGLNEPRH

SEQ ID NO: 6092 - protein, 11 aa, Artificial
  IGFBP-2 heparin binding domain-containing peptide sequence
KKKLGLNEPRH

SEQ ID NO: 6093 - protein, 11 aa, Artificial
  IGFBP-2 heparin binding domain-containing peptide sequence
RKKLGLNEPRH

SEQ ID NO: 6094 - protein, 11 aa, Artificial
  IGFBP-2 heparin binding domain-containing peptide sequence
HKKLGLNEPRH

SEQ ID NO: 6095 - protein, 11 aa, Artificial
  IGFBP-2 heparin binding domain-containing peptide sequence
KRKLGLNEPRH

SEQ ID NO: 6096 - protein, 11 aa, Artificial
  IGFBP-2 heparin binding domain-containing peptide sequence
RRKLGLNEPRH

SEQ ID NO: 6097 - protein, 11 aa, Artificial
  IGFBP-2 heparin binding domain-containing peptide sequence
HRKLGLNEPRH

SEQ ID NO: 6098 - protein, 11 aa, Artificial
  IGFBP-2 heparin binding domain-containing peptide sequence
KHRLGLNEPRH

SEQ ID NO: 6099 - protein, 11 aa, Artificial
  IGFBP-2 heparin binding domain-containing peptide sequence
RHRLGLNEPRH

SEQ ID NO: 6100 - protein, 11 aa, Artificial
  IGFBP-2 heparin binding domain-containing peptide sequence
HHRLGLNEPRH

SEQ ID NO: 6101 - protein, 11 aa, Artificial
  IGFBP-2 heparin binding domain-containing peptide sequence
KKRLGLNEPRH

SEQ ID NO: 6102 - protein, 11 aa, Artificial
  IGFBP-2 heparin binding domain-containing peptide sequence
RKRLGLNEPRH

SEQ ID NO: 6103 - protein, 11 aa, Artificial
  IGFBP-2 heparin binding domain-containing peptide sequence
HKRLGLNEPRH

SEQ ID NO: 6104 - protein, 11 aa, Artificial
  IGFBP-2 heparin binding domain-containing peptide sequence
KRRLGLNEPRH

SEQ ID NO: 6105 - protein, 11 aa, Artificial
  IGFBP-2 heparin binding domain-containing peptide sequence
RRRLGLNEPRH

SEQ ID NO: 6106 - protein, 11 aa, Artificial
  IGFBP-2 heparin binding domain-containing peptide sequence
HRRLGLNEPRH

SEQ ID NO: 6107 - protein, 10 aa, Artificial
  IGFBP-2 heparin binding domain-containing peptide sequence
KHHIGLNPRH

SEQ ID NO: 6108 - protein, 11 aa, Artificial
  IGFBP-2 heparin binding domain-containing peptide sequence
RHHIGLNEPRH

SEQ ID NO: 6109 - protein, 11 aa, Artificial
  IGFBP-2 heparin binding domain-containing peptide sequence
HHHIGLNEPRH

SEQ ID NO: 6110 - protein, 11 aa, Artificial
  IGFBP-2 heparin binding domain-containing peptide sequence
KKHIGLNEPRH

SEQ ID NO: 6111 - protein, 11 aa, Artificial
  IGFBP-2 heparin binding domain-containing peptide sequence
RKHIGLNEPRH

SEQ ID NO: 6112 - protein, 11 aa, Artificial
  IGFBP-2 heparin binding domain-containing peptide sequence
HKHIGLNEPRH

SEQ ID NO: 6113 - protein, 11 aa, Artificial
  IGFBP-2 heparin binding domain-containing peptide sequence
KRHIGLNEPRH

SEQ ID NO: 6114 - protein, 11 aa, Artificial
  IGFBP-2 heparin binding domain-containing peptide sequence
RRHIGLNEPRH

SEQ ID NO: 6115 - protein, 11 aa, Artificial
  IGFBP-2 heparin binding domain-containing peptide sequence
HRHIGLNEPRH

SEQ ID NO: 6116 - protein, 11 aa, Artificial
  IGFBP-2 heparin binding domain-containing peptide sequence
KHKIGLNEPRH

SEQ ID NO: 6117 - protein, 11 aa, Artificial
  IGFBP-2 heparin binding domain-containing peptide sequence
RHKIGLNEPRH

SEQ ID NO: 6118 - protein, 11 aa, Artificial
  IGFBP-2 heparin binding domain-containing peptide sequence
HHKIGLNEPRH

SEQ ID NO: 6119 - protein, 11 aa, Artificial
  IGFBP-2 heparin binding domain-containing peptide sequence
KKKIGLNEPRH

SEQ ID NO: 6120 - protein, 11 aa, Artificial
  IGFBP-2 heparin binding domain-containing peptide sequence
RKKIGLNEPRH

SEQ ID NO: 6121 - protein, 11 aa, Artificial
  IGFBP-2 heparin binding domain-containing peptide sequence
HKKIGLNEPRH

SEQ ID NO: 6122 - protein, 11 aa, Artificial
  IGFBP-2 heparin binding domain-containing peptide sequence
KRKIGLNEPRH

SEQ ID NO: 6123 - protein, 11 aa, Artificial
  IGFBP-2 heparin binding domain-containing peptide sequence
RRKIGLNEPRH

SEQ ID NO: 6124 - protein, 11 aa, Artificial
  IGFBP-2 heparin binding domain-containing peptide sequence
HRKIGLNEPRH

SEQ ID NO: 6125 - protein, 11 aa, Artificial
  IGFBP-2 heparin binding domain-containing peptide sequence
KHRIGLNEPRH

SEQ ID NO: 6126 - protein, 11 aa, Artificial
  IGFBP-2 heparin binding domain-containing peptide sequence
RHRIGLNEPRH

SEQ ID NO: 6127 - protein, 11 aa, Artificial
  IGFBP-2 heparin binding domain-containing peptide sequence
HHRIGLNEPRH

SEQ ID NO: 6128 - protein, 11 aa, Artificial
  IGFBP-2 heparin binding domain-containing peptide sequence
KKRIGLNEPRH

SEQ ID NO: 6129 - protein, 11 aa, Artificial
  IGFBP-2 heparin binding domain-containing peptide sequence
RKRIGLNEPRH

SEQ ID NO: 6130 - protein, 11 aa, Artificial
  IGFBP-2 heparin binding domain-containing peptide sequence
HKRIGLNEPRH

SEQ ID NO: 6131 - protein, 11 aa, Artificial
  IGFBP-2 heparin binding domain-containing peptide sequence
KRRIGLNEPRH

SEQ ID NO: 6132 - protein, 11 aa, Artificial
  IGFBP-2 heparin binding domain-containing peptide sequence
RRRIGLNEPRH

SEQ ID NO: 6133 - protein, 11 aa, Artificial
  IGFBP-2 heparin binding domain-containing peptide sequence
HRRIGLNEPRH

SEQ ID NO: 6134 - protein, 11 aa, Artificial
  IGFBP-2 heparin binding domain-containing peptide sequence
KHHVGLNEPRH

SEQ ID NO: 6135 - protein, 11 aa, Artificial
  IGFBP-2 heparin binding domain-containing peptide sequence
RHHVGLNEPRH

SEQ ID NO: 6136 - protein, 11 aa, Artificial
  IGFBP-2 heparin binding domain-containing peptide sequence
HHHVGLNEPRH

SEQ ID NO: 6137 - protein, 11 aa, Artificial
  IGFBP-2 heparin binding domain-containing peptide sequence
KKHVGLNEPRH

SEQ ID NO: 6138 - protein, 11 aa, Artificial
  IGFBP-2 heparin binding domain-containing peptide sequence
RKHVGLNEPRH

SEQ ID NO: 6139 - protein, 11 aa, Artificial
  IGFBP-2 heparin binding domain-containing peptide sequence
HKHVGLNEPRH

SEQ ID NO: 6140 - protein, 11 aa, Artificial
  IGFBP-2 heparin binding domain-containing peptide sequence
KRHVGLNEPRH

SEQ ID NO: 6141 - protein, 11 aa, Artificial
  IGFBP-2 heparin binding domain-containing peptide sequence
RRHVGLNEPRH

SEQ ID NO: 6142 - protein, 11 aa, Artificial
  IGFBP-2 heparin binding domain-containing peptide sequence
HRHVGLNEPRH

SEQ ID NO: 6143 - protein, 11 aa, Artificial
  IGFBP-2 heparin binding domain-containing peptide sequence
KHKVGLNEPRH

SEQ ID NO: 6144 - protein, 11 aa, Artificial
  IGFBP-2 heparin binding domain-containing peptide sequence
RHKVGLNEPRH

SEQ ID NO: 6145 - protein, 11 aa, Artificial
  IGFBP-2 heparin binding domain-containing peptide sequence
HHKVGLNEPRH

SEQ ID NO: 6146 - protein, 11 aa, Artificial
  IGFBP-2 heparin binding domain-containing peptide sequence
KKKVGLNEPRH

SEQ ID NO: 6147 - protein, 11 aa, Artificial
  IGFBP-2 heparin binding domain-containing peptide sequence
RKKVGLNEPRH

SEQ ID NO: 6148 - protein, 11 aa, Artificial
  IGFBP-2 heparin binding domain-containing peptide sequence
HKKVGLNEPRH

SEQ ID NO: 6149 - protein, 11 aa, Artificial
  IGFBP-2 heparin binding domain-containing peptide sequence
KRKVGLNEPRH

SEQ ID NO: 6150 - protein, 11 aa, Artificial
  IGFBP-2 heparin binding domain-containing peptide sequence
RRKVGLNEPRH

SEQ ID NO: 6151 - protein, 11 aa, Artificial
  IGFBP-2 heparin binding domain-containing peptide sequence
HRKVGLNEPRH

SEQ ID NO: 6152 - protein, 11 aa, Artificial
  IGFBP-2 heparin binding domain-containing peptide sequence
KHRVGLNEPRH

SEQ ID NO: 6153 - protein, 11 aa, Artificial
  IGFBP-2 heparin binding domain-containing peptide sequence
RHRVGLNEPRH

SEQ ID NO: 6154 - protein, 11 aa, Artificial
  IGFBP-2 heparin binding domain-containing peptide sequence
HHRVGLNEPRH

SEQ ID NO: 6155 - protein, 11 aa, Artificial
  IGFBP-2 heparin binding domain-containing peptide sequence
KKRVGLNEPRH

SEQ ID NO: 6156 - protein, 11 aa, Artificial
  IGFBP-2 heparin binding domain-containing peptide sequence
RKRVGLNEPRH

SEQ ID NO: 6157 - protein, 11 aa, Artificial
  IGFBP-2 heparin binding domain-containing peptide sequence
HKRVGLNEPRH

SEQ ID NO: 6158 - protein, 11 aa, Artificial
  IGFBP-2 heparin binding domain-containing peptide sequence
KRRVGLNEPRH

SEQ ID NO: 6159 - protein, 11 aa, Artificial
  IGFBP-2 heparin binding domain-containing peptide sequence
RRRVGLNEPRH

SEQ ID NO: 6160 - protein, 11 aa, Artificial
  IGFBP-2 heparin binding domain-containing peptide sequence
HRRVGLNEPRH

SEQ ID NO: 6161 - protein, 11 aa, Artificial
  IGFBP-2 heparin binding domain-containing peptide sequence
KHHLGINEPRH

SEQ ID NO: 6162 - protein, 11 aa, Artificial
  IGFBP-2 heparin binding domain-containing peptide sequence
RHHLGINEPRH

SEQ ID NO: 6163 - protein, 11 aa, Artificial
  IGFBP-2 heparin binding domain-containing peptide sequence
HHHLGINEPRH

SEQ ID NO: 6164 - protein, 11 aa, Artificial
  IGFBP-2 heparin binding domain-containing peptide sequence
KKHLGINEPRH

SEQ ID NO: 6165 - protein, 11 aa, Artificial
  IGFBP-2 heparin binding domain-containing peptide sequence
RKHLGINEPRH

SEQ ID NO: 6166 - protein, 11 aa, Artificial
  IGFBP-2 heparin binding domain-containing peptide sequence
HKHLGINEPRH

SEQ ID NO: 6167 - protein, 11 aa, Artificial
  IGFBP-2 heparin binding domain-containing peptide sequence
KRHLGINEPRH

SEQ ID NO: 6168 - protein, 11 aa, Artificial
  IGFBP-2 heparin binding domain-containing peptide sequence
RRHLGINEPRH

SEQ ID NO: 6169 - protein, 11 aa, Artificial
  IGFBP-2 heparin binding domain-containing peptide sequence
HRHLGINEPRH

SEQ ID NO: 6170 - protein, 11 aa, Artificial
  IGFBP-2 heparin binding domain-containing peptide sequence
KHKLGINEPRH

SEQ ID NO: 6171 - protein, 11 aa, Artificial
  IGFBP-2 heparin binding domain-containing peptide sequence
RHKLGINEPRH

SEQ ID NO: 6172 - protein, 11 aa, Artificial
  IGFBP-2 heparin binding domain-containing peptide sequence
HHKLGINEPRH

SEQ ID NO: 6173 - protein, 11 aa, Artificial
  IGFBP-2 heparin binding domain-containing peptide sequence
KKKLGINEPRH

SEQ ID NO: 6174 - protein, 11 aa, Artificial
  IGFBP-2 heparin binding domain-containing peptide sequence
RKKLGINEPRH

SEQ ID NO: 6175 - protein, 11 aa, Artificial
  IGFBP-2 heparin binding domain-containing peptide sequence
HKKLGINEPRH

SEQ ID NO: 6176 - protein, 11 aa, Artificial
  IGFBP-2 heparin binding domain-containing peptide sequence
KRKLGINEPRH

SEQ ID NO: 6177 - protein, 11 aa, Artificial
  IGFBP-2 heparin binding domain-containing peptide sequence
RRKLGINEPRH

SEQ ID NO: 6178 - protein, 11 aa, Artificial
  IGFBP-2 heparin binding domain-containing peptide sequence
HRKLGINEPRH

SEQ ID NO: 6179 - protein, 11 aa, Artificial
  IGFBP-2 heparin binding domain-containing peptide sequence
KHRLGINEPRH

SEQ ID NO: 6180 - protein, 11 aa, Artificial
  IGFBP-2 heparin binding domain-containing peptide sequence
RHRLGINEPRH

SEQ ID NO: 6181 - protein, 11 aa, Artificial
  IGFBP-2 heparin binding domain-containing peptide sequence
HHRLGINEPRH

SEQ ID NO: 6182 - protein, 11 aa, Artificial
  IGFBP-2 heparin binding domain-containing peptide sequence
KKRLGINEPRH

SEQ ID NO: 6183 - protein, 11 aa, Artificial
  IGFBP-2 heparin binding domain-containing peptide sequence
RKRLGINEPRH

SEQ ID NO: 6184 - protein, 11 aa, Artificial
  IGFBP-2 heparin binding domain-containing peptide sequence
HKRLGINEPRH

SEQ ID NO: 6185 - protein, 11 aa, Artificial
  IGFBP-2 heparin binding domain-containing peptide sequence
KRRLGINEPRH

SEQ ID NO: 6186 - protein, 11 aa, Artificial
  IGFBP-2 heparin binding domain-containing peptide sequence
RRRLGINEPRH

SEQ ID NO: 6187 - protein, 11 aa, Artificial
  IGFBP-2 heparin binding domain-containing peptide sequence
HRRLGINEPRH

SEQ ID NO: 6188 - protein, 11 aa, Artificial
  IGFBP-2 heparin binding domain-containing peptide sequence
KHHIGIENPRH

SEQ ID NO: 6189 - protein, 11 aa, Artificial
  IGFBP-2 heparin binding domain-containing peptide sequence
RHHIGINEPRH

SEQ ID NO: 6190 - protein, 11 aa, Artificial
  IGFBP-2 heparin binding domain-containing peptide sequence
HHHIGINEPRH

SEQ ID NO: 6191 - protein, 11 aa, Artificial
  IGFBP-2 heparin binding domain-containing peptide sequence
KKHIGINEPRH

SEQ ID NO: 6192 - protein, 11 aa, Artificial
  IGFBP-2 heparin binding domain-containing peptide sequence
RKHIGINEPRH

SEQ ID NO: 6193 - protein, 11 aa, Artificial
  IGFBP-2 heparin binding domain-containing peptide sequence
HKHIGINEPRH

SEQ ID NO: 6194 - protein, 11 aa, Artificial
  IGFBP-2 heparin binding domain-containing peptide sequence
KRHIGINEPRH

SEQ ID NO: 6195 - protein, 11 aa, Artificial
  IGFBP-2 heparin binding domain-containing peptide sequence
RRHIGINEPRH

SEQ ID NO: 6196 - protein, 11 aa, Artificial
  IGFBP-2 heparin binding domain-containing peptide sequence
HRHIGINEPRH

SEQ ID NO: 6197 - protein, 11 aa, Artificial
  IGFBP-2 heparin binding domain-containing peptide sequence
KHKIGINEPRH

SEQ ID NO: 6198 - protein, 11 aa, Artificial
  IGFBP-2 heparin binding domain-containing peptide sequence
RHKIGINEPRH

SEQ ID NO: 6199 - protein, 11 aa, Artificial
  IGFBP-2 heparin binding domain-containing peptide sequence
HHKIGINEPRH

SEQ ID NO: 6200 - protein, 11 aa, Artificial
  IGFBP-2 heparin binding domain-containing peptide sequence
KKKIGINEPRH

SEQ ID NO: 6201 - protein, 11 aa, Artificial
  IGFBP-2 heparin binding domain-containing peptide sequence
RKKIGINEPRH

SEQ ID NO: 6202 - protein, 11 aa, Artificial
  IGFBP-2 heparin binding domain-containing peptide sequence
HKKIGINEPRH

SEQ ID NO: 6203 - protein, 11 aa, Artificial
  IGFBP-2 heparin binding domain-containing peptide sequence
KRKIGINEPRH

SEQ ID NO: 6204 - protein, 11 aa, Artificial
  IGFBP-2 heparin binding domain-containing peptide sequence
RRKIGINEPRH

SEQ ID NO: 6205 - protein, 11 aa, Artificial
  IGFBP-2 heparin binding domain-containing peptide sequence
HRKIGINEPRH

SEQ ID NO: 6206 - protein, 11 aa, Artificial
  IGFBP-2 heparin binding domain-containing peptide sequence
KHRIGINEPRH

SEQ ID NO: 6207 - protein, 11 aa, Artificial
  IGFBP-2 heparin binding domain-containing peptide sequence
RHRIGINEPRH

SEQ ID NO: 6208 - protein, 11 aa, Artificial
  IGFBP-2 heparin binding domain-containing peptide sequence
HHRIGINEPRH

SEQ ID NO: 6209 - protein, 11 aa, Artificial
  IGFBP-2 heparin binding domain-containing peptide sequence
KKRIGINEPRH

SEQ ID NO: 6210 - protein, 11 aa, Artificial
  IGFBP-2 heparin binding domain-containing peptide sequence
RKRIGINEPRH

SEQ ID NO: 6211 - protein, 11 aa, Artificial
  IGFBP-2 heparin binding domain-containing peptide sequence
HKRIGINEPRH

SEQ ID NO: 6212 - protein, 11 aa, Artificial
  IGFBP-2 heparin binding domain-containing peptide sequence
KRRIGINEPRH

SEQ ID NO: 6213 - protein, 11 aa, Artificial
  IGFBP-2 heparin binding domain-containing peptide sequence
RRRIGINEPRH

SEQ ID NO: 6214 - protein, 11 aa, Artificial
  IGFBP-2 heparin binding domain-containing peptide sequence
HRRIGINEPRH

SEQ ID NO: 6215 - protein, 11 aa, Artificial
  IGFBP-2 heparin binding domain-containing peptide sequence
KHHVGINEPRH

SEQ ID NO: 6216 - protein, 11 aa, Artificial
  IGFBP-2 heparin binding domain-containing peptide sequence
RHHVGINEPRH

SEQ ID NO: 6217 - protein, 11 aa, Artificial
  IGFBP-2 heparin binding domain-containing peptide sequence
HHHVGINEPRH

SEQ ID NO: 6218 - protein, 11 aa, Artificial
  IGFBP-2 heparin binding domain-containing peptide sequence
KKHVGINEPRH

SEQ ID NO: 6219 - protein, 11 aa, Artificial
  IGFBP-2 heparin binding domain-containing peptide sequence
RKHVGINEPRH

SEQ ID NO: 6220 - protein, 11 aa, Artificial
  IGFBP-2 heparin binding domain-containing peptide sequence
HKHVGINEPRH

SEQ ID NO: 6221 - protein, 11 aa, Artificial
  IGFBP-2 heparin binding domain-containing peptide sequence
KRHVGINEPRH

SEQ ID NO: 6222 - protein, 11 aa, Artificial
  IGFBP-2 heparin binding domain-containing peptide sequence
RRHVGINEPRH

SEQ ID NO: 6223 - protein, 11 aa, Artificial
  IGFBP-2 heparin binding domain-containing peptide sequence
HRHVGINEPRH

SEQ ID NO: 6224 - protein, 11 aa, Artificial
  IGFBP-2 heparin binding domain-containing peptide sequence
KHKVGINEPRH

SEQ ID NO: 6225 - protein, 11 aa, Artificial
  IGFBP-2 heparin binding domain-containing peptide sequence
RHKVGINEPRH

SEQ ID NO: 6226 - protein, 11 aa, Artificial
  IGFBP-2 heparin binding domain-containing peptide sequence
HHKVGINEPRH

SEQ ID NO: 6227 - protein, 11 aa, Artificial
  IGFBP-2 heparin binding domain-containing peptide sequence
KKKVGINEPRH

SEQ ID NO: 6228 - protein, 11 aa, Artificial
  IGFBP-2 heparin binding domain-containing peptide sequence
RKKVGINEPRH

SEQ ID NO: 6229 - protein, 11 aa, Artificial
  IGFBP-2 heparin binding domain-containing peptide sequence
HKKVGINEPRH

SEQ ID NO: 6230 - protein, 11 aa, Artificial
  IGFBP-2 heparin binding domain-containing peptide sequence
KRKVGINEPRH

SEQ ID NO: 6231 - protein, 11 aa, Artificial
  IGFBP-2 heparin binding domain-containing peptide sequence
RRKVGINEPRH

SEQ ID NO: 6232 - protein, 11 aa, Artificial
  IGFBP-2 heparin binding domain-containing peptide sequence
HRKVGINEPRH

SEQ ID NO: 6233 - protein, 11 aa, Artificial
  IGFBP-2 heparin binding domain-containing peptide sequence
KHRVGINEPRH

SEQ ID NO: 6234 - protein, 11 aa, Artificial
  IGFBP-2 heparin binding domain-containing peptide sequence
RHRVGINEPRH

SEQ ID NO: 6235 - protein, 11 aa, Artificial
  IGFBP-2 heparin binding domain-containing peptide sequence
HHRVGINEPRH

SEQ ID NO: 6236 - protein, 11 aa, Artificial
  IGFBP-2 heparin binding domain-containing peptide sequence
KKRVGINEPRH

SEQ ID NO: 6237 - protein, 11 aa, Artificial
  IGFBP-2 heparin binding domain-containing peptide sequence
RKRVGINEPRH

SEQ ID NO: 6238 - protein, 11 aa, Artificial
  IGFBP-2 heparin binding domain-containing peptide sequence
HKRVGINEPRH

SEQ ID NO: 6239 - protein, 11 aa, Artificial
  IGFBP-2 heparin binding domain-containing peptide sequence
KRRVGINEPRH

SEQ ID NO: 6240 - protein, 11 aa, Artificial
  IGFBP-2 heparin binding domain-containing peptide sequence
RRRVGINEPRH

SEQ ID NO: 6241 - protein, 11 aa, Artificial
  IGFBP-2 heparin binding domain-containing peptide sequence
HRRVGINEPRH

SEQ ID NO: 6242 - protein, 11 aa, Artificial
  IGFBP-2 heparin binding domain-containing peptide sequence
KHHLGVNEPRH

SEQ ID NO: 6243 - protein, 11 aa, Artificial
  IGFBP-2 heparin binding domain-containing peptide sequence
RHHLGVNEPRH

SEQ ID NO: 6244 - protein, 11 aa, Artificial
  IGFBP-2 heparin binding domain-containing peptide sequence
HHHLGVNEPRH

SEQ ID NO: 6245 - protein, 11 aa, Artificial
  IGFBP-2 heparin binding domain-containing peptide sequence
KKHLGVNEPRH

SEQ ID NO: 6246 - protein, 11 aa, Artificial
  IGFBP-2 heparin binding domain-containing peptide sequence
RKHLGVNEPRH

SEQ ID NO: 6247 - protein, 11 aa, Artificial
  IGFBP-2 heparin binding domain-containing peptide sequence
HKHLGVNEPRH

SEQ ID NO: 6248 - protein, 11 aa, Artificial
  IGFBP-2 heparin binding domain-containing peptide sequence
KRHLGVNEPRH

SEQ ID NO: 6249 - protein, 11 aa, Artificial
  IGFBP-2 heparin binding domain-containing peptide sequence
RRHLGVNEPRH

SEQ ID NO: 6250 - protein, 11 aa, Artificial
  IGFBP-2 heparin binding domain-containing peptide sequence
HRHLGVNEPRH

SEQ ID NO: 6251 - protein, 11 aa, Artificial
  IGFBP-2 heparin binding domain-containing peptide sequence
KHKLGVNEPRH

SEQ ID NO: 6252 - protein, 11 aa, Artificial
  IGFBP-2 heparin binding domain-containing peptide sequence
RHKLGVNEPRH

SEQ ID NO: 6253 - protein, 11 aa, Artificial
  IGFBP-2 heparin binding domain-containing peptide sequence
HHKLGVNEPRH

SEQ ID NO: 6254 - protein, 11 aa, Artificial
  IGFBP-2 heparin binding domain-containing peptide sequence
KKKLGVNEPRH

SEQ ID NO: 6255 - protein, 11 aa, Artificial
  IGFBP-2 heparin binding domain-containing peptide sequence
RKKLGVNEPRH

SEQ ID NO: 6256 - protein, 11 aa, Artificial
  IGFBP-2 heparin binding domain-containing peptide sequence
HKKLGVNEPRH

SEQ ID NO: 6257 - protein, 11 aa, Artificial
  IGFBP-2 heparin binding domain-containing peptide sequence
KRKLGVNEPRH

SEQ ID NO: 6258 - protein, 11 aa, Artificial
  IGFBP-2 heparin binding domain-containing peptide sequence
RRKLGVNEPRH

SEQ ID NO: 6259 - protein, 11 aa, Artificial
  IGFBP-2 heparin binding domain-containing peptide sequence
HRKLGVNEPRH

SEQ ID NO: 6260 - protein, 11 aa, Artificial
  IGFBP-2 heparin binding domain-containing peptide sequence
KHRLGVNEPRH

SEQ ID NO: 6261 - protein, 11 aa, Artificial
  IGFBP-2 heparin binding domain-containing peptide sequence
RHRLGVNEPRH

SEQ ID NO: 6262 - protein, 11 aa, Artificial
  IGFBP-2 heparin binding domain-containing peptide sequence
HHRLGVNEPRH

SEQ ID NO: 6263 - protein, 11 aa, Artificial
  IGFBP-2 heparin binding domain-containing peptide sequence
KKRLGVNEPRH

SEQ ID NO: 6264 - protein, 11 aa, Artificial
  IGFBP-2 heparin binding domain-containing peptide sequence
RKRLGVNEPRH

SEQ ID NO: 6265 - protein, 11 aa, Artificial
  IGFBP-2 heparin binding domain-containing peptide sequence
HKRLGVNEPRH

SEQ ID NO: 6266 - protein, 11 aa, Artificial
  IGFBP-2 heparin binding domain-containing peptide sequence
KRRLGVNEPRH

SEQ ID NO: 6267 - protein, 11 aa, Artificial
  IGFBP-2 heparin binding domain-containing peptide sequence
RRRLGVNEPRH

SEQ ID NO: 6268 - protein, 11 aa, Artificial
  IGFBP-2 heparin binding domain-containing peptide sequence
HRRLGVNEPRH

SEQ ID NO: 6269 - protein, 11 aa, Artificial
  IGFBP-2 heparin binding domain-containing peptide sequence
KHHIGVNEPRH

SEQ ID NO: 6270 - protein, 11 aa, Artificial
  IGFBP-2 heparin binding domain-containing peptide sequence
RHHIGVNEPRH

SEQ ID NO: 6271 - protein, 11 aa, Artificial
  IGFBP-2 heparin binding domain-containing peptide sequence
HHHIGVNEPRH

SEQ ID NO: 6272 - protein, 11 aa, Artificial
  IGFBP-2 heparin binding domain-containing peptide sequence
KKHIGVNEPRH

SEQ ID NO: 6273 - protein, 11 aa, Artificial
  IGFBP-2 heparin binding domain-containing peptide sequence
RKHIGVNEPRH

SEQ ID NO: 6274 - protein, 11 aa, Artificial
  IGFBP-2 heparin binding domain-containing peptide sequence
HKHIGVNEPRH

SEQ ID NO: 6275 - protein, 11 aa, Artificial
  IGFBP-2 heparin binding domain-containing peptide sequence
KRHIGVNEPRH

SEQ ID NO: 6276 - protein, 11 aa, Artificial
  IGFBP-2 heparin binding domain-containing peptide sequence
RRHIGVNEPRH

SEQ ID NO: 6277 - protein, 11 aa, Artificial
  IGFBP-2 heparin binding domain-containing peptide sequence
HRHIGVNEPRH

SEQ ID NO: 6278 - protein, 11 aa, Artificial
  IGFBP-2 heparin binding domain-containing peptide sequence
KHKIGVNEPRH

SEQ ID NO: 6279 - protein, 11 aa, Artificial
  IGFBP-2 heparin binding domain-containing peptide sequence
RHKIGVNEPRH

SEQ ID NO: 6280 - protein, 11 aa, Artificial
  IGFBP-2 heparin binding domain-containing peptide sequence
HHKIGVNEPRH

SEQ ID NO: 6281 - protein, 11 aa, Artificial
  IGFBP-2 heparin binding domain-containing peptide sequence
KKKIGVNEPRH

SEQ ID NO: 6282 - protein, 11 aa, Artificial
  IGFBP-2 heparin binding domain-containing peptide sequence
RKKIGVNEPRH

SEQ ID NO: 6283 - protein, 11 aa, Artificial
  IGFBP-2 heparin binding domain-containing peptide sequence
HKKIGVNEPRH

SEQ ID NO: 6284 - protein, 11 aa, Artificial
  IGFBP-2 heparin binding domain-containing peptide sequence
KRKIGVNEPRH

SEQ ID NO: 6285 - protein, 11 aa, Artificial
  IGFBP-2 heparin binding domain-containing peptide sequence
RRKIGVNEPRH

SEQ ID NO: 6286 - protein, 11 aa, Artificial
  IGFBP-2 heparin binding domain-containing peptide sequence
HRKIGVNEPRH

SEQ ID NO: 6287 - protein, 11 aa, Artificial
  IGFBP-2 heparin binding domain-containing peptide sequence
KHRIGVNEPRH

SEQ ID NO: 6288 - protein, 11 aa, Artificial
  IGFBP-2 heparin binding domain-containing peptide sequence
RHRIGVNEPRH

SEQ ID NO: 6289 - protein, 11 aa, Artificial
  IGFBP-2 heparin binding domain-containing peptide sequence
HHRIGVNEPRH

SEQ ID NO: 6290 - protein, 11 aa, Artificial
  IGFBP-2 heparin binding domain-containing peptide sequence
KKRIGVNEPRH

SEQ ID NO: 6291 - protein, 11 aa, Artificial
  IGFBP-2 heparin binding domain-containing peptide sequence
RKRIGVNEPRH

SEQ ID NO: 6292 - protein, 11 aa, Artificial
  IGFBP-2 heparin binding domain-containing peptide sequence
HKRIGVNEPRH

SEQ ID NO: 6293 - protein, 11 aa, Artificial
  IGFBP-2 heparin binding domain-containing peptide sequence
KRRIGVNEPRH

SEQ ID NO: 6294 - protein, 11 aa, Artificial
  IGFBP-2 heparin binding domain-containing peptide sequence
RRRIGVNEPRH

SEQ ID NO: 6295 - protein, 11 aa, Artificial
  IGFBP-2 heparin binding domain-containing peptide sequence
HRRIGVNEPRH

SEQ ID NO: 6296 - protein, 11 aa, Artificial
  IGFBP-2 heparin binding domain-containing peptide sequence
KHHVGVNEPRH

SEQ ID NO: 6297 - protein, 11 aa, Artificial
  IGFBP-2 heparin binding domain-containing peptide sequence
RHHVGVNEPRH

SEQ ID NO: 6298 - protein, 11 aa, Artificial
  IGFBP-2 heparin binding domain-containing peptide sequence
HHHVGVNEPRH

SEQ ID NO: 6299 - protein, 11 aa, Artificial
  IGFBP-2 heparin binding domain-containing peptide sequence
KKHVGVNEPRH

SEQ ID NO: 6300 - protein, 11 aa, Artificial
  IGFBP-2 heparin binding domain-containing peptide sequence
RKHVGVNEPRH

SEQ ID NO: 6301 - protein, 11 aa, Artificial
  IGFBP-2 heparin binding domain-containing peptide sequence
HKHVGVNEPRH

SEQ ID NO: 6302 - protein, 11 aa, Artificial
  IGFBP-2 heparin binding domain-containing peptide sequence
KRHVGVNEPRH

SEQ ID NO: 6303 - protein, 11 aa, Artificial
  IGFBP-2 heparin binding domain-containing peptide sequence
RRHVGVNEPRH

SEQ ID NO: 6304 - protein, 11 aa, Artificial
  IGFBP-2 heparin binding domain-containing peptide sequence
HRHVGVNEPRH

SEQ ID NO: 6305 - protein, 11 aa, Artificial
  IGFBP-2 heparin binding domain-containing peptide sequence
KHKVGVNEPRH

SEQ ID NO: 6306 - protein, 11 aa, Artificial
  IGFBP-2 heparin binding domain-containing peptide sequence
RHKVGVNEPRH

SEQ ID NO: 6307 - protein, 11 aa, Artificial
  IGFBP-2 heparin binding domain-containing peptide sequence
HHKVGVNEPRH

SEQ ID NO: 6308 - protein, 11 aa, Artificial
  IGFBP-2 heparin binding domain-containing peptide sequence
KKKVGVNEPRH

SEQ ID NO: 6309 - protein, 11 aa, Artificial
  IGFBP-2 heparin binding domain-containing peptide sequence
RKKVGVNEPRH

SEQ ID NO: 6310 - protein, 11 aa, Artificial
  IGFBP-2 heparin binding domain-containing peptide sequence
HKKVGVNEPRH

SEQ ID NO: 6311 - protein, 11 aa, Artificial
  IGFBP-2 heparin binding domain-containing peptide sequence
KRKVGVNEPRH

SEQ ID NO: 6312 - protein, 11 aa, Artificial
  IGFBP-2 heparin binding domain-containing peptide sequence
RRKVGVNEPRH

SEQ ID NO: 6313 - protein, 11 aa, Artificial
  IGFBP-2 heparin binding domain-containing peptide sequence
HRKVGVNEPRH

SEQ ID NO: 6314 - protein, 11 aa, Artificial
  IGFBP-2 heparin binding domain-containing peptide sequence
KHRVGVNEPRH

SEQ ID NO: 6315 - protein, 11 aa, Artificial
  IGFBP-2 heparin binding domain-containing peptide sequence
RHRVGVNEPRH

SEQ ID NO: 6316 - protein, 11 aa, Artificial
  IGFBP-2 heparin binding domain-containing peptide sequence
HHRVGVNEPRH

SEQ ID NO: 6317 - protein, 11 aa, Artificial
  IGFBP-2 heparin binding domain-containing peptide sequence
KKRVGVNEPRH

SEQ ID NO: 6318 - protein, 11 aa, Artificial
  IGFBP-2 heparin binding domain-containing peptide sequence
RKRVGVNEPRH

SEQ ID NO: 6319 - protein, 11 aa, Artificial
  IGFBP-2 heparin binding domain-containing peptide sequence
HKRVGVNEPRH

SEQ ID NO: 6320 - protein, 11 aa, Artificial
  IGFBP-2 heparin binding domain-containing peptide sequence
KRRVGVNEPRH

SEQ ID NO: 6321 - protein, 11 aa, Artificial
  IGFBP-2 heparin binding domain-containing peptide sequence
RRRVGVNEPRH

SEQ ID NO: 6322 - protein, 11 aa, Artificial
  IGFBP-2 heparin binding domain-containing peptide sequence
HRRVGVNEPRH

SEQ ID NO: 6323 - protein, 11 aa, Artificial
  IGFBP-2 heparin binding domain-containing peptide sequence
KHHLGLENPRH

SEQ ID NO: 6324 - protein, 11 aa, Artificial
  IGFBP-2 heparin binding domain-containing peptide sequence
RHHLGLENPRH

SEQ ID NO: 6325 - protein, 11 aa, Artificial
  IGFBP-2 heparin binding domain-containing peptide sequence
HHHLGLENPRH

SEQ ID NO: 6326 - protein, 11 aa, Artificial
  IGFBP-2 heparin binding domain-containing peptide sequence
KKHLGLENPRH

SEQ ID NO: 6327 - protein, 11 aa, Artificial
  IGFBP-2 heparin binding domain-containing peptide sequence
RKHLGLENPRH

SEQ ID NO: 6328 - protein, 11 aa, Artificial
  IGFBP-2 heparin binding domain-containing peptide sequence
HKHLGLENPRH

SEQ ID NO: 6329 - protein, 11 aa, Artificial
  IGFBP-2 heparin binding domain-containing peptide sequence
KRHLGLENPRH

SEQ ID NO: 6330 - protein, 11 aa, Artificial
  IGFBP-2 heparin binding domain-containing peptide sequence
RRHLGLENPRH

SEQ ID NO: 6331 - protein, 11 aa, Artificial
  IGFBP-2 heparin binding domain-containing peptide sequence
HRHLGLENPRH

SEQ ID NO: 6332 - protein, 11 aa, Artificial
  IGFBP-2 heparin binding domain-containing peptide sequence
KHKLGLENPRH

SEQ ID NO: 6333 - protein, 11 aa, Artificial
  IGFBP-2 heparin binding domain-containing peptide sequence
RHKLGLENPRH

SEQ ID NO: 6334 - protein, 11 aa, Artificial
  IGFBP-2 heparin binding domain-containing peptide sequence
HHKLGLENPRH

SEQ ID NO: 6335 - protein, 11 aa, Artificial
  IGFBP-2 heparin binding domain-containing peptide sequence
KKKLGLENPRH

SEQ ID NO: 6336 - protein, 11 aa, Artificial
  IGFBP-2 heparin binding domain-containing peptide sequence
RKKLGLENPRH

SEQ ID NO: 6337 - protein, 11 aa, Artificial
  IGFBP-2 heparin binding domain-containing peptide sequence
HKKLGLENPRH

SEQ ID NO: 6338 - protein, 11 aa, Artificial
  IGFBP-2 heparin binding domain-containing peptide sequence
KRKLGLENPRH

SEQ ID NO: 6339 - protein, 11 aa, Artificial
  IGFBP-2 heparin binding domain-containing peptide sequence
RRKLGLENPRH

SEQ ID NO: 6340 - protein, 11 aa, Artificial
  IGFBP-2 heparin binding domain-containing peptide sequence
HRKLGLENPRH

SEQ ID NO: 6341 - protein, 11 aa, Artificial
  IGFBP-2 heparin binding domain-containing peptide sequence
KHRLGLENPRH

SEQ ID NO: 6342 - protein, 11 aa, Artificial
  IGFBP-2 heparin binding domain-containing peptide sequence
RHRLGLENPRH

SEQ ID NO: 6343 - protein, 11 aa, Artificial
  IGFBP-2 heparin binding domain-containing peptide sequence
HHRLGLENPRH

SEQ ID NO: 6344 - protein, 11 aa, Artificial
  IGFBP-2 heparin binding domain-containing peptide sequence
KKRLGLENPRH

SEQ ID NO: 6345 - protein, 11 aa, Artificial
  IGFBP-2 heparin binding domain-containing peptide sequence
RKRLGLENPRH

SEQ ID NO: 6346 - protein, 11 aa, Artificial
  IGFBP-2 heparin binding domain-containing peptide sequence
HKRLGLENPRH

SEQ ID NO: 6347 - protein, 11 aa, Artificial
  IGFBP-2 heparin binding domain-containing peptide sequence
KRRLGLENPRH

SEQ ID NO: 6348 - protein, 11 aa, Artificial
  IGFBP-2 heparin binding domain-containing peptide sequence
RRRLGLENPRH

SEQ ID NO: 6349 - protein, 11 aa, Artificial
  IGFBP-2 heparin binding domain-containing peptide sequence
HRRLGLENPRH

SEQ ID NO: 6350 - protein, 11 aa, Artificial
  IGFBP-2 heparin binding domain-containing peptide sequence
KHHIGLENPRH

SEQ ID NO: 6351 - protein, 11 aa, Artificial
  IGFBP-2 heparin binding domain-containing peptide sequence
RHHIGLENPRH

SEQ ID NO: 6352 - protein, 11 aa, Artificial
  IGFBP-2 heparin binding domain-containing peptide sequence
HHHIGLENPRH

SEQ ID NO: 6353 - protein, 11 aa, Artificial
  IGFBP-2 heparin binding domain-containing peptide sequence
KKHIGLENPRH

SEQ ID NO: 6354 - protein, 11 aa, Artificial
  IGFBP-2 heparin binding domain-containing peptide sequence
RKHIGLENPRH

SEQ ID NO: 6355 - protein, 11 aa, Artificial
  IGFBP-2 heparin binding domain-containing peptide sequence
HKHIGLENPRH

SEQ ID NO: 6356 - protein, 11 aa, Artificial
  IGFBP-2 heparin binding domain-containing peptide sequence
KRHIGLENPRH

SEQ ID NO: 6357 - protein, 11 aa, Artificial
  IGFBP-2 heparin binding domain-containing peptide sequence
RRHIGLENPRH

SEQ ID NO: 6358 - protein, 11 aa, Artificial
  IGFBP-2 heparin binding domain-containing peptide sequence
HRHIGLENPRH

SEQ ID NO: 6359 - protein, 11 aa, Artificial
  IGFBP-2 heparin binding domain-containing peptide sequence
KHKIGLENPRH

SEQ ID NO: 6360 - protein, 11 aa, Artificial
  IGFBP-2 heparin binding domain-containing peptide sequence
RHKIGLENPRH

SEQ ID NO: 6361 - protein, 11 aa, Artificial
  IGFBP-2 heparin binding domain-containing peptide sequence
HHKIGLENPRH

SEQ ID NO: 6362 - protein, 11 aa, Artificial
  IGFBP-2 heparin binding domain-containing peptide sequence
KKKIGLENPRH

SEQ ID NO: 6363 - protein, 11 aa, Artificial
  IGFBP-2 heparin binding domain-containing peptide sequence
RKKIGLENPRH

SEQ ID NO: 6364 - protein, 11 aa, Artificial
  IGFBP-2 heparin binding domain-containing peptide sequence
HKKIGLENPRH

SEQ ID NO: 6365 - protein, 11 aa, Artificial
  IGFBP-2 heparin binding domain-containing peptide sequence
KRKIGLENPRH

SEQ ID NO: 6366 - protein, 11 aa, Artificial
  IGFBP-2 heparin binding domain-containing peptide sequence
RRKIGLENPRH

SEQ ID NO: 6367 - protein, 11 aa, Artificial
  IGFBP-2 heparin binding domain-containing peptide sequence
HRKIGLENPRH

SEQ ID NO: 6368 - protein, 11 aa, Artificial
  IGFBP-2 heparin binding domain-containing peptide sequence
KHRIGLENPRH

SEQ ID NO: 6369 - protein, 11 aa, Artificial
  IGFBP-2 heparin binding domain-containing peptide sequence
RHRIGLENPRH

SEQ ID NO: 6370 - protein, 11 aa, Artificial
  IGFBP-2 heparin binding domain-containing peptide sequence
HHRIGLENPRH

SEQ ID NO: 6371 - protein, 11 aa, Artificial
  IGFBP-2 heparin binding domain-containing peptide sequence
KKRIGLENPRH

SEQ ID NO: 6372 - protein, 11 aa, Artificial
  IGFBP-2 heparin binding domain-containing peptide sequence
RKRIGLENPRH

SEQ ID NO: 6373 - protein, 11 aa, Artificial
  IGFBP-2 heparin binding domain-containing peptide sequence
HKRIGLENPRH

SEQ ID NO: 6374 - protein, 11 aa, Artificial
  IGFBP-2 heparin binding domain-containing peptide sequence
KRRIGLENPRH

SEQ ID NO: 6375 - protein, 11 aa, Artificial
  IGFBP-2 heparin binding domain-containing peptide sequence
RRRIGLENPRH

SEQ ID NO: 6376 - protein, 11 aa, Artificial
  IGFBP-2 heparin binding domain-containing peptide sequence
HRRIGLENPRH

SEQ ID NO: 6377 - protein, 11 aa, Artificial
  IGFBP-2 heparin binding domain-containing peptide sequence
KHHVGLENPRH

SEQ ID NO: 6378 - protein, 11 aa, Artificial
  IGFBP-2 heparin binding domain-containing peptide sequence
RHHVGLENPRH

SEQ ID NO: 6379 - protein, 11 aa, Artificial
  IGFBP-2 heparin binding domain-containing peptide sequence
HHHVGLENPRH

SEQ ID NO: 6380 - protein, 11 aa, Artificial
  IGFBP-2 heparin binding domain-containing peptide sequence
KKHVGLENPRH

SEQ ID NO: 6381 - protein, 11 aa, Artificial
  IGFBP-2 heparin binding domain-containing peptide sequence
RKHVGLENPRH

SEQ ID NO: 6382 - protein, 11 aa, Artificial
  IGFBP-2 heparin binding domain-containing peptide sequence
HKHVGLENPRH

SEQ ID NO: 6383 - protein, 11 aa, Artificial
  IGFBP-2 heparin binding domain-containing peptide sequence
KRHVGLENPRH

SEQ ID NO: 6384 - protein, 11 aa, Artificial
  IGFBP-2 heparin binding domain-containing peptide sequence
RRHVGLENPRH

SEQ ID NO: 6385 - protein, 11 aa, Artificial
  IGFBP-2 heparin binding domain-containing peptide sequence
HRHVGLENPRH

SEQ ID NO: 6386 - protein, 11 aa, Artificial
  IGFBP-2 heparin binding domain-containing peptide sequence
KHKVGLENPRH

SEQ ID NO: 6387 - protein, 11 aa, Artificial
  IGFBP-2 heparin binding domain-containing peptide sequence
RHKVGLENPRH

SEQ ID NO: 6388 - protein, 11 aa, Artificial
  IGFBP-2 heparin binding domain-containing peptide sequence
HHKVGLENPRH

SEQ ID NO: 6389 - protein, 11 aa, Artificial
  IGFBP-2 heparin binding domain-containing peptide sequence
KKKVGLENPRH

SEQ ID NO: 6390 - protein, 11 aa, Artificial
  IGFBP-2 heparin binding domain-containing peptide sequence
RKKVGLENPRH

SEQ ID NO: 6391 - protein, 11 aa, Artificial
  IGFBP-2 heparin binding domain-containing peptide sequence
HKKVGLENPRH

SEQ ID NO: 6392 - protein, 11 aa, Artificial
  IGFBP-2 heparin binding domain-containing peptide sequence
KRKVGLENPRH

SEQ ID NO: 6393 - protein, 11 aa, Artificial
  IGFBP-2 heparin binding domain-containing peptide sequence
RRKVGLENPRH

SEQ ID NO: 6394 - protein, 11 aa, Artificial
  IGFBP-2 heparin binding domain-containing peptide sequence
HRKVGLENPRH

SEQ ID NO: 6395 - protein, 11 aa, Artificial
  IGFBP-2 heparin binding domain-containing peptide sequence
KHRVGLENPRH

SEQ ID NO: 6396 - protein, 11 aa, Artificial
  IGFBP-2 heparin binding domain-containing peptide sequence
RHRVGLENPRH

SEQ ID NO: 6397 - protein, 11 aa, Artificial
  IGFBP-2 heparin binding domain-containing peptide sequence
HHRVGLENPRH

SEQ ID NO: 6398 - protein, 11 aa, Artificial
  IGFBP-2 heparin binding domain-containing peptide sequence
KKRVGLENPRH

SEQ ID NO: 6399 - protein, 11 aa, Artificial
  IGFBP-2 heparin binding domain-containing peptide sequence
RKRVGLENPRH

SEQ ID NO: 6400 - protein, 11 aa, Artificial
  IGFBP-2 heparin binding domain-containing peptide sequence
HKRVGLENPRH

SEQ ID NO: 6401 - protein, 11 aa, Artificial
  IGFBP-2 heparin binding domain-containing peptide sequence
KRRVGLENPRH

SEQ ID NO: 6402 - protein, 11 aa, Artificial
  IGFBP-2 heparin binding domain-containing peptide sequence
RRRVGLENPRH

SEQ ID NO: 6403 - protein, 11 aa, Artificial
  IGFBP-2 heparin binding domain-containing peptide sequence
HRRVGLENPRH

SEQ ID NO: 6404 - protein, 11 aa, Artificial
  IGFBP-2 heparin binding domain-containing peptide sequence
KHHLGIENPRH

SEQ ID NO: 6405 - protein, 11 aa, Artificial
  IGFBP-2 heparin binding domain-containing peptide sequence
RHHLGIENPRH

SEQ ID NO: 6406 - protein, 11 aa, Artificial
  IGFBP-2 heparin binding domain-containing peptide sequence
HHHLGIENPRH

SEQ ID NO: 6407 - protein, 11 aa, Artificial
  IGFBP-2 heparin binding domain-containing peptide sequence
KKHLGIENPRH

SEQ ID NO: 6408 - protein, 11 aa, Artificial
  IGFBP-2 heparin binding domain-containing peptide sequence
RKHLGIENPRH

SEQ ID NO: 6409 - protein, 11 aa, Artificial
  IGFBP-2 heparin binding domain-containing peptide sequence
HKHLGIENPRH

SEQ ID NO: 6410 - protein, 11 aa, Artificial
  IGFBP-2 heparin binding domain-containing peptide sequence
KRHLGIENPRH

SEQ ID NO: 6411 - protein, 11 aa, Artificial
  IGFBP-2 heparin binding domain-containing peptide sequence
RRHLGIENPRH

SEQ ID NO: 6412 - protein, 11 aa, Artificial
  IGFBP-2 heparin binding domain-containing peptide sequence
HRHLGIENPRH

SEQ ID NO: 6413 - protein, 11 aa, Artificial
  IGFBP-2 heparin binding domain-containing peptide sequence
KHKLGIENPRH

SEQ ID NO: 6414 - protein, 11 aa, Artificial
  IGFBP-2 heparin binding domain-containing peptide sequence
RHKLGIENPRH

SEQ ID NO: 6415 - protein, 11 aa, Artificial
  IGFBP-2 heparin binding domain-containing peptide sequence
HHKLGIENPRH

SEQ ID NO: 6416 - protein, 11 aa, Artificial
  IGFBP-2 heparin binding domain-containing peptide sequence
KKKLGIENPRH

SEQ ID NO: 6417 - protein, 11 aa, Artificial
  IGFBP-2 heparin binding domain-containing peptide sequence
RKKLGIENPRH

SEQ ID NO: 6418 - protein, 11 aa, Artificial
  IGFBP-2 heparin binding domain-containing peptide sequence
HKKLGIENPRH

SEQ ID NO: 6419 - protein, 11 aa, Artificial
  IGFBP-2 heparin binding domain-containing peptide sequence
KRKLGIENPRH

SEQ ID NO: 6420 - protein, 11 aa, Artificial
  IGFBP-2 heparin binding domain-containing peptide sequence
RRKLGIENPRH

SEQ ID NO: 6421 - protein, 11 aa, Artificial
  IGFBP-2 heparin binding domain-containing peptide sequence
HRKLGIENPRH

SEQ ID NO: 6422 - protein, 11 aa, Artificial
  IGFBP-2 heparin binding domain-containing peptide sequence
KHRLGIENPRH

SEQ ID NO: 6423 - protein, 11 aa, Artificial
  IGFBP-2 heparin binding domain-containing peptide sequence
RHRLGIENPRH

SEQ ID NO: 6424 - protein, 11 aa, Artificial
  IGFBP-2 heparin binding domain-containing peptide sequence
HHRLGIENPRH

SEQ ID NO: 6425 - protein, 11 aa, Artificial
  IGFBP-2 heparin binding domain-containing peptide sequence
KKRLGIENPRH

SEQ ID NO: 6426 - protein, 11 aa, Artificial
  IGFBP-2 heparin binding domain-containing peptide sequence
RKRLGIENPRH

SEQ ID NO: 6427 - protein, 11 aa, Artificial
  IGFBP-2 heparin binding domain-containing peptide sequence
HKRLGIENPRH

SEQ ID NO: 6428 - protein, 11 aa, Artificial
  IGFBP-2 heparin binding domain-containing peptide sequence
KRRLGIENPRH

SEQ ID NO: 6429 - protein, 11 aa, Artificial
  IGFBP-2 heparin binding domain-containing peptide sequence
RRRLGIENPRH

SEQ ID NO: 6430 - protein, 11 aa, Artificial
  IGFBP-2 heparin binding domain-containing peptide sequence
HRRLGIENPRH

SEQ ID NO: 6431 - protein, 11 aa, Artificial
  IGFBP-2 heparin binding domain-containing peptide sequence
KHHIGIENPRH

SEQ ID NO: 6432 - protein, 11 aa, Artificial
  IGFBP-2 heparin binding domain-containing peptide sequence
RHHIGIENPRH

SEQ ID NO: 6433 - protein, 11 aa, Artificial
  IGFBP-2 heparin binding domain-containing peptide sequence
HHHIGIENPRH

SEQ ID NO: 6434 - protein, 11 aa, Artificial
  IGFBP-2 heparin binding domain-containing peptide sequence
KKHIGIENPRH

SEQ ID NO: 6435 - protein, 11 aa, Artificial
  IGFBP-2 heparin binding domain-containing peptide sequence
RKHIGIENPRH

SEQ ID NO: 6436 - protein, 11 aa, Artificial
  IGFBP-2 heparin binding domain-containing peptide sequence
HKHIGIENPRH

SEQ ID NO: 6437 - protein, 11 aa, Artificial
  IGFBP-2 heparin binding domain-containing peptide sequence
KRHIGIENPRH

SEQ ID NO: 6438 - protein, 11 aa, Artificial
  IGFBP-2 heparin binding domain-containing peptide sequence
RRHIGIENPRH

SEQ ID NO: 6439 - protein, 11 aa, Artificial
  IGFBP-2 heparin binding domain-containing peptide sequence
HRHIGIENPRH

SEQ ID NO: 6440 - protein, 11 aa, Artificial
  IGFBP-2 heparin binding domain-containing peptide sequence
KHKIGIENPRH

SEQ ID NO: 6441 - protein, 11 aa, Artificial
  IGFBP-2 heparin binding domain-containing peptide sequence
RHKIGIENPRH

SEQ ID NO: 6442 - protein, 11 aa, Artificial
  IGFBP-2 heparin binding domain-containing peptide sequence
HHKIGIENPRH

SEQ ID NO: 6443 - protein, 11 aa, Artificial
  IGFBP-2 heparin binding domain-containing peptide sequence
KKKIGIENPRH

SEQ ID NO: 6444 - protein, 11 aa, Artificial
  IGFBP-2 heparin binding domain-containing peptide sequence
RKKIGIENPRH

SEQ ID NO: 6445 - protein, 11 aa, Artificial
  IGFBP-2 heparin binding domain-containing peptide sequence
HKKIGIENPRH

SEQ ID NO: 6446 - protein, 11 aa, Artificial
  IGFBP-2 heparin binding domain-containing peptide sequence
KRKIGIENPRH

SEQ ID NO: 6447 - protein, 11 aa, Artificial
  IGFBP-2 heparin binding domain-containing peptide sequence
RRKIGIENPRH

SEQ ID NO: 6448 - protein, 11 aa, Artificial
  IGFBP-2 heparin binding domain-containing peptide sequence
HRKIGIENPRH

SEQ ID NO: 6449 - protein, 11 aa, Artificial
  IGFBP-2 heparin binding domain-containing peptide sequence
KHRIGIENPRH

SEQ ID NO: 6450 - protein, 11 aa, Artificial
  IGFBP-2 heparin binding domain-containing peptide sequence
RHRIGIENPRH

SEQ ID NO: 6451 - protein, 11 aa, Artificial
  IGFBP-2 heparin binding domain-containing peptide sequence
HHRIGIENPRH

SEQ ID NO: 6452 - protein, 11 aa, Artificial
  IGFBP-2 heparin binding domain-containing peptide sequence
KKRIGIENPRH

SEQ ID NO: 6453 - protein, 11 aa, Artificial
  IGFBP-2 heparin binding domain-containing peptide sequence
RKRIGIENPRH

SEQ ID NO: 6454 - protein, 11 aa, Artificial
  IGFBP-2 heparin binding domain-containing peptide sequence
HKRIGIENPRH

SEQ ID NO: 6455 - protein, 11 aa, Artificial
  IGFBP-2 heparin binding domain-containing peptide sequence
KRRIGIENPRH

SEQ ID NO: 6456 - protein, 11 aa, Artificial
  IGFBP-2 heparin binding domain-containing peptide sequence
RRRIGIENPRH

SEQ ID NO: 6457 - protein, 11 aa, Artificial
  IGFBP-2 heparin binding domain-containing peptide sequence
HRRIGIENPRH

SEQ ID NO: 6458 - protein, 11 aa, Artificial
  IGFBP-2 heparin binding domain-containing peptide sequence
KHHVGIENPRH

SEQ ID NO: 6459 - protein, 11 aa, Artificial
  IGFBP-2 heparin binding domain-containing peptide sequence
RHHVGIENPRH

SEQ ID NO: 6460 - protein, 11 aa, Artificial
  IGFBP-2 heparin binding domain-containing peptide sequence
HHHVGIENPRH

SEQ ID NO: 6461 - protein, 11 aa, Artificial
  IGFBP-2 heparin binding domain-containing peptide sequence
KKHVGIENPRH

SEQ ID NO: 6462 - protein, 11 aa, Artificial
  IGFBP-2 heparin binding domain-containing peptide sequence
RKHVGIENPRH

SEQ ID NO: 6463 - protein, 11 aa, Artificial
  IGFBP-2 heparin binding domain-containing peptide sequence
HKHVGIENPRH

SEQ ID NO: 6464 - protein, 11 aa, Artificial
  IGFBP-2 heparin binding domain-containing peptide sequence
KRHVGIENPRH

SEQ ID NO: 6465 - protein, 11 aa, Artificial
  IGFBP-2 heparin binding domain-containing peptide sequence
RRHVGIENPRH

SEQ ID NO: 6466 - protein, 11 aa, Artificial
  IGFBP-2 heparin binding domain-containing peptide sequence
HRHVGIENPRH

SEQ ID NO: 6467 - protein, 11 aa, Artificial
  IGFBP-2 heparin binding domain-containing peptide sequence
KHKVGIENPRH

SEQ ID NO: 6468 - protein, 11 aa, Artificial
  IGFBP-2 heparin binding domain-containing peptide sequence
RHKVGIENPRH

SEQ ID NO: 6469 - protein, 11 aa, Artificial
  IGFBP-2 heparin binding domain-containing peptide sequence
HHKVGIENPRH

SEQ ID NO: 6470 - protein, 11 aa, Artificial
  IGFBP-2 heparin binding domain-containing peptide sequence
KKKVGIENPRH

SEQ ID NO: 6471 - protein, 11 aa, Artificial
  IGFBP-2 heparin binding domain-containing peptide sequence
RKKVGIENPRH

SEQ ID NO: 6472 - protein, 11 aa, Artificial
  IGFBP-2 heparin binding domain-containing peptide sequence
HKKVGIENPRH

SEQ ID NO: 6473 - protein, 11 aa, Artificial
  IGFBP-2 heparin binding domain-containing peptide sequence
KRKVGIENPRH

SEQ ID NO: 6474 - protein, 11 aa, Artificial
  IGFBP-2 heparin binding domain-containing peptide sequence
RRKVGIENPRH

SEQ ID NO: 6475 - protein, 11 aa, Artificial
  IGFBP-2 heparin binding domain-containing peptide sequence
HRKVGIENPRH

SEQ ID NO: 6476 - protein, 11 aa, Artificial
  IGFBP-2 heparin binding domain-containing peptide sequence
KHRVGIENPRH

SEQ ID NO: 6477 - protein, 11 aa, Artificial
  IGFBP-2 heparin binding domain-containing peptide sequence
RHRVGIENPRH

SEQ ID NO: 6478 - protein, 11 aa, Artificial
  IGFBP-2 heparin binding domain-containing peptide sequence
HHRVGIENPRH

SEQ ID NO: 6479 - protein, 11 aa, Artificial
  IGFBP-2 heparin binding domain-containing peptide sequence
KKRVGIENPRH

SEQ ID NO: 6480 - protein, 11 aa, Artificial
  IGFBP-2 heparin binding domain-containing peptide sequence
RKRVGIENPRH

SEQ ID NO: 6481 - protein, 11 aa, Artificial
  IGFBP-2 heparin binding domain-containing peptide sequence
HKRVGIENPRH

SEQ ID NO: 6482 - protein, 11 aa, Artificial
  IGFBP-2 heparin binding domain-containing peptide sequence
KRRVGIENPRH

SEQ ID NO: 6483 - protein, 11 aa, Artificial
  IGFBP-2 heparin binding domain-containing peptide sequence
RRRVGIENPRH

SEQ ID NO: 6484 - protein, 11 aa, Artificial
  IGFBP-2 heparin binding domain-containing peptide sequence
HRRVGIENPRH

SEQ ID NO: 6485 - protein, 11 aa, Artificial
  IGFBP-2 heparin binding domain-containing peptide sequence
KHHLGVENPRH

SEQ ID NO: 6486 - protein, 11 aa, Artificial
  IGFBP-2 heparin binding domain-containing peptide sequence
RHHLGVENPRH

SEQ ID NO: 6487 - protein, 11 aa, Artificial
  IGFBP-2 heparin binding domain-containing peptide sequence
HHHLGVENPRH

SEQ ID NO: 6488 - protein, 11 aa, Artificial
  IGFBP-2 heparin binding domain-containing peptide sequence
KKHLGVENPRH

SEQ ID NO: 6489 - protein, 11 aa, Artificial
  IGFBP-2 heparin binding domain-containing peptide sequence
RKHLGVENPRH

SEQ ID NO: 6490 - protein, 11 aa, Artificial
  IGFBP-2 heparin binding domain-containing peptide sequence
HKHLGVENPRH

SEQ ID NO: 6491 - protein, 11 aa, Artificial
  IGFBP-2 heparin binding domain-containing peptide sequence
KRHLGVENPRH

SEQ ID NO: 6492 - protein, 11 aa, Artificial
  IGFBP-2 heparin binding domain-containing peptide sequence
RRHLGVENPRH

SEQ ID NO: 6493 - protein, 11 aa, Artificial
  IGFBP-2 heparin binding domain-containing peptide sequence
HRHLGVENPRH

SEQ ID NO: 6494 - protein, 11 aa, Artificial
  IGFBP-2 heparin binding domain-containing peptide sequence
KHKLGVENPRH

SEQ ID NO: 6495 - protein, 11 aa, Artificial
  IGFBP-2 heparin binding domain-containing peptide sequence
RHKLGVENPRH

SEQ ID NO: 6496 - protein, 11 aa, Artificial
  IGFBP-2 heparin binding domain-containing peptide sequence
HHKLGVENPRH

SEQ ID NO: 6497 - protein, 11 aa, Artificial
  IGFBP-2 heparin binding domain-containing peptide sequence
KKKLGVENPRH

SEQ ID NO: 6498 - protein, 11 aa, Artificial
  IGFBP-2 heparin binding domain-containing peptide sequence
RKKLGVENPRH

SEQ ID NO: 6499 - protein, 11 aa, Artificial
  IGFBP-2 heparin binding domain-containing peptide sequence
HKKLGVENPRH

SEQ ID NO: 6500 - protein, 11 aa, Artificial
  IGFBP-2 heparin binding domain-containing peptide sequence
KRKLGVENPRH

SEQ ID NO: 6501 - protein, 11 aa, Artificial
  IGFBP-2 heparin binding domain-containing peptide sequence
RRKLGVENPRH

SEQ ID NO: 6502 - protein, 11 aa, Artificial
  IGFBP-2 heparin binding domain-containing peptide sequence
HRKLGVENPRH

SEQ ID NO: 6503 - protein, 11 aa, Artificial
  IGFBP-2 heparin binding domain-containing peptide sequence
KHRLGVENPRH

SEQ ID NO: 6504 - protein, 11 aa, Artificial
  IGFBP-2 heparin binding domain-containing peptide sequence
RHRLGVENPRH

SEQ ID NO: 6505 - protein, 11 aa, Artificial
  IGFBP-2 heparin binding domain-containing peptide sequence
HHRLGVENPRH

SEQ ID NO: 6506 - protein, 11 aa, Artificial
  IGFBP-2 heparin binding domain-containing peptide sequence
KKRLGVENPRH

SEQ ID NO: 6507 - protein, 11 aa, Artificial
  IGFBP-2 heparin binding domain-containing peptide sequence
RKRLGVENPRH

SEQ ID NO: 6508 - protein, 11 aa, Artificial
  IGFBP-2 heparin binding domain-containing peptide sequence
HKRLGVENPRH

SEQ ID NO: 6509 - protein, 11 aa, Artificial
  IGFBP-2 heparin binding domain-containing peptide sequence
KRRLGVENPRH

SEQ ID NO: 6510 - protein, 11 aa, Artificial
  IGFBP-2 heparin binding domain-containing peptide sequence
RRRLGVENPRH

SEQ ID NO: 6511 - protein, 11 aa, Artificial
  IGFBP-2 heparin binding domain-containing peptide sequence
HRRLGVENPRH

SEQ ID NO: 6512 - protein, 11 aa, Artificial
  IGFBP-2 heparin binding domain-containing peptide sequence
KHHIGVENPRH

SEQ ID NO: 6513 - protein, 11 aa, Artificial
  IGFBP-2 heparin binding domain-containing peptide sequence
RHHIGVEEPRH

SEQ ID NO: 6514 - protein, 11 aa, Artificial
  IGFBP-2 heparin binding domain-containing peptide sequence
HHHIGVENPRH

SEQ ID NO: 6515 - protein, 11 aa, Artificial
  IGFBP-2 heparin binding domain-containing peptide sequence
KKHIGVENPRH

SEQ ID NO: 6516 - protein, 11 aa, Artificial
  IGFBP-2 heparin binding domain-containing peptide sequence
RKHIGVENPRH

SEQ ID NO: 6517 - protein, 11 aa, Artificial
  IGFBP-2 heparin binding domain-containing peptide sequence
HKHIGVENPRH

SEQ ID NO: 6518 - protein, 11 aa, Artificial
  IGFBP-2 heparin binding domain-containing peptide sequence
KRHIGVENPRH

SEQ ID NO: 6519 - protein, 11 aa, Artificial
  IGFBP-2 heparin binding domain-containing peptide sequence
RRHIGVENPRH

SEQ ID NO: 6520 - protein, 11 aa, Artificial
  IGFBP-2 heparin binding domain-containing peptide sequence
HRHIGVENPRH

SEQ ID NO: 6521 - protein, 11 aa, Artificial
  IGFBP-2 heparin binding domain-containing peptide sequence
KHKIGVENPRH

SEQ ID NO: 6522 - protein, 11 aa, Artificial
  IGFBP-2 heparin binding domain-containing peptide sequence
RHKIGVENPRH

SEQ ID NO: 6523 - protein, 11 aa, Artificial
  IGFBP-2 heparin binding domain-containing peptide sequence
HHKIGVENPRH

SEQ ID NO: 6524 - protein, 11 aa, Artificial
  IGFBP-2 heparin binding domain-containing peptide sequence
KKKIGVENPRH

SEQ ID NO: 6525 - protein, 11 aa, Artificial
  IGFBP-2 heparin binding domain-containing peptide sequence
RKKIGVENPRH

SEQ ID NO: 6526 - protein, 11 aa, Artificial
  IGFBP-2 heparin binding domain-containing peptide sequence
HKKIGVENPRH

SEQ ID NO: 6527 - protein, 11 aa, Artificial
  IGFBP-2 heparin binding domain-containing peptide sequence
KRKIGVENPRH

SEQ ID NO: 6528 - protein, 11 aa, Artificial
  IGFBP-2 heparin binding domain-containing peptide sequence
RRKIGVENPRH

SEQ ID NO: 6529 - protein, 11 aa, Artificial
  IGFBP-2 heparin binding domain-containing peptide sequence
HRKIGVENPRH

SEQ ID NO: 6530 - protein, 11 aa, Artificial
  IGFBP-2 heparin binding domain-containing peptide sequence
KHRIGVENPRH

SEQ ID NO: 6531 - protein, 11 aa, Artificial
  IGFBP-2 heparin binding domain-containing peptide sequence
RHRIGVENPRH

SEQ ID NO: 6532 - protein, 11 aa, Artificial
  IGFBP-2 heparin binding domain-containing peptide sequence
HHRIGVENPRH

SEQ ID NO: 6533 - protein, 11 aa, Artificial
  IGFBP-2 heparin binding domain-containing peptide sequence
KKRIGVENPRH

SEQ ID NO: 6534 - protein, 11 aa, Artificial
  IGFBP-2 heparin binding domain-containing peptide sequence
RKRIGVENPRH

SEQ ID NO: 6535 - protein, 11 aa, Artificial
  IGFBP-2 heparin binding domain-containing peptide sequence
HKRIGVENPRH

SEQ ID NO: 6536 - protein, 11 aa, Artificial
  IGFBP-2 heparin binding domain-containing peptide sequence
KRRIGVENPRH

SEQ ID NO: 6537 - protein, 11 aa, Artificial
  IGFBP-2 heparin binding domain-containing peptide sequence
RRRIGVENPRH

SEQ ID NO: 6538 - protein, 11 aa, Artificial
  IGFBP-2 heparin binding domain-containing peptide sequence
HRRIGVENPRH

SEQ ID NO: 6539 - protein, 11 aa, Artificial
  IGFBP-2 heparin binding domain-containing peptide sequence
KHHVGVENPRH

SEQ ID NO: 6540 - protein, 11 aa, Artificial
  IGFBP-2 heparin binding domain-containing peptide sequence
RHHVGVENPRH

SEQ ID NO: 6541 - protein, 11 aa, Artificial
  IGFBP-2 heparin binding domain-containing peptide sequence
HHHVGVENPRH

SEQ ID NO: 6542 - protein, 11 aa, Artificial
  IGFBP-2 heparin binding domain-containing peptide sequence
KKHVGVENPRH

SEQ ID NO: 6543 - protein, 11 aa, Artificial
  IGFBP-2 heparin binding domain-containing peptide sequence
RKHVGVENPRH

SEQ ID NO: 6544 - protein, 11 aa, Artificial
  IGFBP-2 heparin binding domain-containing peptide sequence
HKHVGVENPRH

SEQ ID NO: 6545 - protein, 11 aa, Artificial
  IGFBP-2 heparin binding domain-containing peptide sequence
KRHVGVENPRH

SEQ ID NO: 6546 - protein, 11 aa, Artificial
  IGFBP-2 heparin binding domain-containing peptide sequence
RRHVGVENPRH

SEQ ID NO: 6547 - protein, 11 aa, Artificial
  IGFBP-2 heparin binding domain-containing peptide sequence
HRHVGVENPRH

SEQ ID NO: 6548 - protein, 11 aa, Artificial
  IGFBP-2 heparin binding domain-containing peptide sequence
KHKVGVENPRH

SEQ ID NO: 6549 - protein, 11 aa, Artificial
  IGFBP-2 heparin binding domain-containing peptide sequence
RHKVGVENPRH

SEQ ID NO: 6550 - protein, 11 aa, Artificial
  IGFBP-2 heparin binding domain-containing peptide sequence
HHKVGVENPRH

SEQ ID NO: 6551 - protein, 11 aa, Artificial
  IGFBP-2 heparin binding domain-containing peptide sequence
KKKVGVENPRH

SEQ ID NO: 6552 - protein, 11 aa, Artificial
  IGFBP-2 heparin binding domain-containing peptide sequence
RKKVGVENPRH

SEQ ID NO: 6553 - protein, 11 aa, Artificial
  IGFBP-2 heparin binding domain-containing peptide sequence
HKKVGVENPRH

SEQ ID NO: 6554 - protein, 11 aa, Artificial
  IGFBP-2 heparin binding domain-containing peptide sequence
KRKVGVENPRH

SEQ ID NO: 6555 - protein, 11 aa, Artificial
  IGFBP-2 heparin binding domain-containing peptide sequence
RRKVGVEEPRH

SEQ ID NO: 6556 - protein, 11 aa, Artificial
  IGFBP-2 heparin binding domain-containing peptide sequence
HRKVGVENPRH

SEQ ID NO: 6557 - protein, 11 aa, Artificial
  IGFBP-2 heparin binding domain-containing peptide sequence
KHRVGVENPRH

SEQ ID NO: 6558 - protein, 11 aa, Artificial
  IGFBP-2 heparin binding domain-containing peptide sequence
RHRVGVENPRH

SEQ ID NO: 6559 - protein, 11 aa, Artificial
  IGFBP-2 heparin binding domain-containing peptide sequence
HHRVGVENPRH

SEQ ID NO: 6560 - protein, 11 aa, Artificial
  IGFBP-2 heparin binding domain-containing peptide sequence
KKRVGVENPRH

SEQ ID NO: 6561 - protein, 11 aa, Artificial
  IGFBP-2 heparin binding domain-containing peptide sequence
RKRVGVENPRH

SEQ ID NO: 6562 - protein, 11 aa, Artificial
  IGFBP-2 heparin binding domain-containing peptide sequence
HKRVGVENPRH

SEQ ID NO: 6563 - protein, 11 aa, Artificial
  IGFBP-2 heparin binding domain-containing peptide sequence
KRRVGVENPRH

SEQ ID NO: 6564 - protein, 11 aa, Artificial
  IGFBP-2 heparin binding domain-containing peptide sequence
RRRVGVENPRH

SEQ ID NO: 6565 - protein, 11 aa, Artificial
  IGFBP-2 heparin binding domain-containing peptide sequence
HRRVGVENPRH

SEQ ID NO: 6566 - protein, 11 aa, Artificial
  IGFBP-2 heparin binding domain-containing peptide sequence
KHHLGLNNPRH

SEQ ID NO: 6567 - protein, 11 aa, Artificial
  IGFBP-2 heparin binding domain-containing peptide sequence
RHHLGLNNPRH

SEQ ID NO: 6568 - protein, 11 aa, Artificial
  IGFBP-2 heparin binding domain-containing peptide sequence
HHHLGLNNPRH

SEQ ID NO: 6569 - protein, 11 aa, Artificial
  IGFBP-2 heparin binding domain-containing peptide sequence
KKHLGLNNPRH

SEQ ID NO: 6570 - protein, 11 aa, Artificial
  IGFBP-2 heparin binding domain-containing peptide sequence
RKHLGLNNPRH

SEQ ID NO: 6571 - protein, 11 aa, Artificial
  IGFBP-2 heparin binding domain-containing peptide sequence
HKHLGLNNPRH

SEQ ID NO: 6572 - protein, 11 aa, Artificial
  IGFBP-2 heparin binding domain-containing peptide sequence
KRHLGLNNPRH

SEQ ID NO: 6573 - protein, 11 aa, Artificial
  IGFBP-2 heparin binding domain-containing peptide sequence
RRHLGLNNPRH

SEQ ID NO: 6574 - protein, 11 aa, Artificial
  IGFBP-2 heparin binding domain-containing peptide sequence
HRHLGLNNPRH

SEQ ID NO: 6575 - protein, 11 aa, Artificial
  IGFBP-2 heparin binding domain-containing peptide sequence
KHKLGLNNPRH

SEQ ID NO: 6576 - protein, 11 aa, Artificial
  IGFBP-2 heparin binding domain-containing peptide sequence
RHKLGLNNPRH

SEQ ID NO: 6577 - protein, 11 aa, Artificial
  IGFBP-2 heparin binding domain-containing peptide sequence
HHKLGLNNPRH

SEQ ID NO: 6578 - protein, 11 aa, Artificial
  IGFBP-2 heparin binding domain-containing peptide sequence
KKKLGLNNPRH

SEQ ID NO: 6579 - protein, 11 aa, Artificial
  IGFBP-2 heparin binding domain-containing peptide sequence
RKKLGLNNPRH

SEQ ID NO: 6580 - protein, 11 aa, Artificial
  IGFBP-2 heparin binding domain-containing peptide sequence
HKKLGLNNPRH

SEQ ID NO: 6581 - protein, 11 aa, Artificial
  IGFBP-2 heparin binding domain-containing peptide sequence
KRKLGLNNPRH

SEQ ID NO: 6582 - protein, 11 aa, Artificial
  IGFBP-2 heparin binding domain-containing peptide sequence
RRKLGLNNPRH

SEQ ID NO: 6583 - protein, 11 aa, Artificial
  IGFBP-2 heparin binding domain-containing peptide sequence
HRKLGLNNPRH

SEQ ID NO: 6584 - protein, 11 aa, Artificial
  IGFBP-2 heparin binding domain-containing peptide sequence
KHRLGLNNPRH

SEQ ID NO: 6585 - protein, 11 aa, Artificial
  IGFBP-2 heparin binding domain-containing peptide sequence
RHRLGLNNPRH

SEQ ID NO: 6586 - protein, 11 aa, Artificial
  IGFBP-2 heparin binding domain-containing peptide sequence
HHRLGLNNPRH

SEQ ID NO: 6587 - protein, 11 aa, Artificial
  IGFBP-2 heparin binding domain-containing peptide sequence
KKRLGLNNPRH

SEQ ID NO: 6588 - protein, 11 aa, Artificial
  IGFBP-2 heparin binding domain-containing peptide sequence
RKRLGLNNPRH

SEQ ID NO: 6589 - protein, 11 aa, Artificial
  IGFBP-2 heparin binding domain-containing peptide sequence
HKRLGLNNPRH

SEQ ID NO: 6590 - protein, 11 aa, Artificial
  IGFBP-2 heparin binding domain-containing peptide sequence
KRRLGLNNPRH

SEQ ID NO: 6591 - protein, 11 aa, Artificial
  IGFBP-2 heparin binding domain-containing peptide sequence
RRRLGLNNPRH

SEQ ID NO: 6592 - protein, 11 aa, Artificial
  IGFBP-2 heparin binding domain-containing peptide sequence
HRRLGLNNPRH

SEQ ID NO: 6593 - protein, 11 aa, Artificial
  IGFBP-2 heparin binding domain-containing peptide sequence
KHHIGLNNPRH

SEQ ID NO: 6594 - protein, 11 aa, Artificial
  IGFBP-2 heparin binding domain-containing peptide sequence
RHHIGLNNPRH

SEQ ID NO: 6595 - protein, 11 aa, Artificial
  IGFBP-2 heparin binding domain-containing peptide sequence
HHHIGLNNPRH

SEQ ID NO: 6596 - protein, 11 aa, Artificial
  IGFBP-2 heparin binding domain-containing peptide sequence
KKHIGLNNPRH

SEQ ID NO: 6597 - protein, 11 aa, Artificial
  IGFBP-2 heparin binding domain-containing peptide sequence
RKHIGLNNPRH

SEQ ID NO: 6598 - protein, 11 aa, Artificial
  IGFBP-2 heparin binding domain-containing peptide sequence
HKHIGLNNPRH

SEQ ID NO: 6599 - protein, 11 aa, Artificial
  IGFBP-2 heparin binding domain-containing peptide sequence
KRHIGLNNPRH

SEQ ID NO: 6600 - protein, 11 aa, Artificial
  IGFBP-2 heparin binding domain-containing peptide sequence
RRHIGLNNPRH

SEQ ID NO: 6601 - protein, 11 aa, Artificial
  IGFBP-2 heparin binding domain-containing peptide sequence
HRHIGLNNPRH

SEQ ID NO: 6602 - protein, 11 aa, Artificial
  IGFBP-2 heparin binding domain-containing peptide sequence
KHKIGLNNPRH

SEQ ID NO: 6603 - protein, 11 aa, Artificial
  IGFBP-2 heparin binding domain-containing peptide sequence
RHKIGLNNPRH

SEQ ID NO: 6604 - protein, 11 aa, Artificial
  IGFBP-2 heparin binding domain-containing peptide sequence
HHKIGLNNPRH

SEQ ID NO: 6605 - protein, 11 aa, Artificial
  IGFBP-2 heparin binding domain-containing peptide sequence
KKKIGLNNPRH

SEQ ID NO: 6606 - protein, 11 aa, Artificial
  IGFBP-2 heparin binding domain-containing peptide sequence
RKKIGLNNPRH

SEQ ID NO: 6607 - protein, 11 aa, Artificial
  IGFBP-2 heparin binding domain-containing peptide sequence
HKKIGLNNPRH

SEQ ID NO: 6608 - protein, 11 aa, Artificial
  IGFBP-2 heparin binding domain-containing peptide sequence
KRKIGLNNPRH

SEQ ID NO: 6609 - protein, 11 aa, Artificial
  IGFBP-2 heparin binding domain-containing peptide sequence
RRKIGLNNPRH

SEQ ID NO: 6610 - protein, 11 aa, Artificial
  IGFBP-2 heparin binding domain-containing peptide sequence
HRKIGLNNPRH

SEQ ID NO: 6611 - protein, 11 aa, Artificial
  IGFBP-2 heparin binding domain-containing peptide sequence
KHRIGLNNPRH

SEQ ID NO: 6612 - protein, 11 aa, Artificial
  IGFBP-2 heparin binding domain-containing peptide sequence
RHRIGLNNPRH

SEQ ID NO: 6613 - protein, 11 aa, Artificial
  IGFBP-2 heparin binding domain-containing peptide sequence
HHRIGLNNPRH

SEQ ID NO: 6614 - protein, 11 aa, Artificial
  IGFBP-2 heparin binding domain-containing peptide sequence
KKRIGLNNPRH

SEQ ID NO: 6615 - protein, 11 aa, Artificial
  IGFBP-2 heparin binding domain-containing peptide sequence
RKRIGLNNPRH

SEQ ID NO: 6616 - protein, 11 aa, Artificial
  IGFBP-2 heparin binding domain-containing peptide sequence
HKRIGLNNPRH

SEQ ID NO: 6617 - protein, 11 aa, Artificial
  IGFBP-2 heparin binding domain-containing peptide sequence
KRRIGLNNPRH

SEQ ID NO: 6618 - protein, 11 aa, Artificial
  IGFBP-2 heparin binding domain-containing peptide sequence
RRRIGLNNPRH

SEQ ID NO: 6619 - protein, 11 aa, Artificial
  IGFBP-2 heparin binding domain-containing peptide sequence
HRRIGLNNPRH

SEQ ID NO: 6620 - protein, 11 aa, Artificial
  IGFBP-2 heparin binding domain-containing peptide sequence
KHHVGLNNPRH

SEQ ID NO: 6621 - protein, 11 aa, Artificial
  IGFBP-2 heparin binding domain-containing peptide sequence
RHHVGLNNPRH

SEQ ID NO: 6622 - protein, 11 aa, Artificial
  IGFBP-2 heparin binding domain-containing peptide sequence
HHHVGLNNPRH

SEQ ID NO: 6623 - protein, 11 aa, Artificial
  IGFBP-2 heparin binding domain-containing peptide sequence
KKHVGLNNPRH

SEQ ID NO: 6624 - protein, 11 aa, Artificial
  IGFBP-2 heparin binding domain-containing peptide sequence
RKHVGLNNPRH

SEQ ID NO: 6625 - protein, 11 aa, Artificial
  IGFBP-2 heparin binding domain-containing peptide sequence
HKHVGLNNPRH

SEQ ID NO: 6626 - protein, 11 aa, Artificial
  IGFBP-2 heparin binding domain-containing peptide sequence
KRHVGLNNPRH

SEQ ID NO: 6627 - protein, 11 aa, Artificial
  IGFBP-2 heparin binding domain-containing peptide sequence
RRHVGLNNPRH

SEQ ID NO: 6628 - protein, 11 aa, Artificial
  IGFBP-2 heparin binding domain-containing peptide sequence
HRHVGLNNPRH

SEQ ID NO: 6629 - protein, 11 aa, Artificial
  IGFBP-2 heparin binding domain-containing peptide sequence
KHKVGLNNPRH

SEQ ID NO: 6630 - protein, 11 aa, Artificial
  IGFBP-2 heparin binding domain-containing peptide sequence
RHKVGLNNPRH

SEQ ID NO: 6631 - protein, 11 aa, Artificial
  IGFBP-2 heparin binding domain-containing peptide sequence
HHKVGLNNPRH

SEQ ID NO: 6632 - protein, 11 aa, Artificial
  IGFBP-2 heparin binding domain-containing peptide sequence
KKKVGLNNPRH

SEQ ID NO: 6633 - protein, 11 aa, Artificial
  IGFBP-2 heparin binding domain-containing peptide sequence
RKKVGLNNPRH

SEQ ID NO: 6634 - protein, 11 aa, Artificial
  IGFBP-2 heparin binding domain-containing peptide sequence
HKKVGLNNPRH

SEQ ID NO: 6635 - protein, 11 aa, Artificial
  IGFBP-2 heparin binding domain-containing peptide sequence
KRKVGLNNPRH

SEQ ID NO: 6636 - protein, 11 aa, Artificial
  IGFBP-2 heparin binding domain-containing peptide sequence
RRKVGLNNPRH

SEQ ID NO: 6637 - protein, 11 aa, Artificial
  IGFBP-2 heparin binding domain-containing peptide sequence
HRKVGLNNPRH

SEQ ID NO: 6638 - protein, 11 aa, Artificial
  IGFBP-2 heparin binding domain-containing peptide sequence
KHRVGLNNPRH

SEQ ID NO: 6639 - protein, 11 aa, Artificial
  IGFBP-2 heparin binding domain-containing peptide sequence
RHRVGLNNPRH

SEQ ID NO: 6640 - protein, 11 aa, Artificial
  IGFBP-2 heparin binding domain-containing peptide sequence
HHRVGLNNPRH

SEQ ID NO: 6641 - protein, 11 aa, Artificial
  IGFBP-2 heparin binding domain-containing peptide sequence
KKRVGLNNPRH

SEQ ID NO: 6642 - protein, 11 aa, Artificial
  IGFBP-2 heparin binding domain-containing peptide sequence
RKRVGLNNPRH

SEQ ID NO: 6643 - protein, 11 aa, Artificial
  IGFBP-2 heparin binding domain-containing peptide sequence
HKRVGLNNPRH

SEQ ID NO: 6644 - protein, 11 aa, Artificial
  IGFBP-2 heparin binding domain-containing peptide sequence
KRRVGLNNPRH

SEQ ID NO: 6645 - protein, 11 aa, Artificial
  IGFBP-2 heparin binding domain-containing peptide sequence
RRRVGLNNPRH

SEQ ID NO: 6646 - protein, 11 aa, Artificial
  IGFBP-2 heparin binding domain-containing peptide sequence
HRRVGLNNPRH

SEQ ID NO: 6647 - protein, 11 aa, Artificial
  IGFBP-2 heparin binding domain-containing peptide sequence
KHHLGINNPRH

SEQ ID NO: 6648 - protein, 11 aa, Artificial
  IGFBP-2 heparin binding domain-containing peptide sequence
RHHLGINNPRH

SEQ ID NO: 6649 - protein, 11 aa, Artificial
  IGFBP-2 heparin binding domain-containing peptide sequence
HHHLGINNPRH

SEQ ID NO: 6650 - protein, 11 aa, Artificial
  IGFBP-2 heparin binding domain-containing peptide sequence
KKHLGINNPRH

SEQ ID NO: 6651 - protein, 11 aa, Artificial
  IGFBP-2 heparin binding domain-containing peptide sequence
RKHLGINNPRH

SEQ ID NO: 6652 - protein, 11 aa, Artificial
  IGFBP-2 heparin binding domain-containing peptide sequence
HKHLGINNPRH

SEQ ID NO: 6653 - protein, 11 aa, Artificial
  IGFBP-2 heparin binding domain-containing peptide sequence
KRHLGINNPRH

SEQ ID NO: 6654 - protein, 11 aa, Artificial
  IGFBP-2 heparin binding domain-containing peptide sequence
RRHLGINNPRH

SEQ ID NO: 6655 - protein, 11 aa, Artificial
  IGFBP-2 heparin binding domain-containing peptide sequence
HRHLGINNPRH

SEQ ID NO: 6656 - protein, 11 aa, Artificial
  IGFBP-2 heparin binding domain-containing peptide sequence
KHKLGINNPRH

SEQ ID NO: 6657 - protein, 11 aa, Artificial
  IGFBP-2 heparin binding domain-containing peptide sequence
RHKLGINNPRH

SEQ ID NO: 6658 - protein, 11 aa, Artificial
  IGFBP-2 heparin binding domain-containing peptide sequence
HHKLGINNPRH

SEQ ID NO: 6659 - protein, 11 aa, Artificial
  IGFBP-2 heparin binding domain-containing peptide sequence
KKKLGINNPRH

SEQ ID NO: 6660 - protein, 11 aa, Artificial
  IGFBP-2 heparin binding domain-containing peptide sequence
RKKLGINNPRH

SEQ ID NO: 6661 - protein, 11 aa, Artificial
  IGFBP-2 heparin binding domain-containing peptide sequence
HKKLGINNPRH

SEQ ID NO: 6662 - protein, 11 aa, Artificial
  IGFBP-2 heparin binding domain-containing peptide sequence
KRKLGINNPRH

SEQ ID NO: 6663 - protein, 11 aa, Artificial
  IGFBP-2 heparin binding domain-containing peptide sequence
RRKLGINNPRH

SEQ ID NO: 6664 - protein, 11 aa, Artificial
  IGFBP-2 heparin binding domain-containing peptide sequence
HRKLGINNPRH

SEQ ID NO: 6665 - protein, 11 aa, Artificial
  IGFBP-2 heparin binding domain-containing peptide sequence
KHRLGINNPRH

SEQ ID NO: 6666 - protein, 11 aa, Artificial
  IGFBP-2 heparin binding domain-containing peptide sequence
RHRLGINNPRH

SEQ ID NO: 6667 - protein, 11 aa, Artificial
  IGFBP-2 heparin binding domain-containing peptide sequence
HHRLGINNPRH

SEQ ID NO: 6668 - protein, 11 aa, Artificial
  IGFBP-2 heparin binding domain-containing peptide sequence
KKRLGINNPRH

SEQ ID NO: 6669 - protein, 11 aa, Artificial
  IGFBP-2 heparin binding domain-containing peptide sequence
RKRLGINNPRH

SEQ ID NO: 6670 - protein, 11 aa, Artificial
  IGFBP-2 heparin binding domain-containing peptide sequence
HKRLGINNPRH

SEQ ID NO: 6671 - protein, 11 aa, Artificial
  IGFBP-2 heparin binding domain-containing peptide sequence
KRRLGINNPRH

SEQ ID NO: 6672 - protein, 11 aa, Artificial
  IGFBP-2 heparin binding domain-containing peptide sequence
RRRLGINNPRH

SEQ ID NO: 6673 - protein, 11 aa, Artificial
  IGFBP-2 heparin binding domain-containing peptide sequence
HRRLGINNPRH

SEQ ID NO: 6674 - protein, 11 aa, Artificial
  IGFBP-2 heparin binding domain-containing peptide sequence
KHHIGIENPRH

SEQ ID NO: 6675 - protein, 11 aa, Artificial
  IGFBP-2 heparin binding domain-containing peptide sequence
RHHIGINNPRH

SEQ ID NO: 6676 - protein, 11 aa, Artificial
  IGFBP-2 heparin binding domain-containing peptide sequence
HHHIGINNPRH

SEQ ID NO: 6677 - protein, 11 aa, Artificial
  IGFBP-2 heparin binding domain-containing peptide sequence
KKHIGINNPRH

SEQ ID NO: 6678 - protein, 11 aa, Artificial
  IGFBP-2 heparin binding domain-containing peptide sequence
RKHIGINNPRH

SEQ ID NO: 6679 - protein, 11 aa, Artificial
  IGFBP-2 heparin binding domain-containing peptide sequence
HKHIGINNPRH

SEQ ID NO: 6680 - protein, 11 aa, Artificial
  IGFBP-2 heparin binding domain-containing peptide sequence
KRHIGINNPRH

SEQ ID NO: 6681 - protein, 11 aa, Artificial
  IGFBP-2 heparin binding domain-containing peptide sequence
RRHIGINNPRH

SEQ ID NO: 6682 - protein, 11 aa, Artificial
  IGFBP-2 heparin binding domain-containing peptide sequence
HRHIGINNPRH

SEQ ID NO: 6683 - protein, 11 aa, Artificial
  IGFBP-2 heparin binding domain-containing peptide sequence
KHKIGINNPRH

SEQ ID NO: 6684 - protein, 11 aa, Artificial
  IGFBP-2 heparin binding domain-containing peptide sequence
RHKIGINNPRH

SEQ ID NO: 6685 - protein, 11 aa, Artificial
  IGFBP-2 heparin binding domain-containing peptide sequence
HHKIGINNPRH

SEQ ID NO: 6686 - protein, 11 aa, Artificial
  IGFBP-2 heparin binding domain-containing peptide sequence
KKKIGINNPRH

SEQ ID NO: 6687 - protein, 11 aa, Artificial
  IGFBP-2 heparin binding domain-containing peptide sequence
RKKIGINNPRH

SEQ ID NO: 6688 - protein, 11 aa, Artificial
  IGFBP-2 heparin binding domain-containing peptide sequence
HKKIGINNPRH

SEQ ID NO: 6689 - protein, 11 aa, Artificial
  IGFBP-2 heparin binding domain-containing peptide sequence
KRKIGINNPRH

SEQ ID NO: 6690 - protein, 11 aa, Artificial
  IGFBP-2 heparin binding domain-containing peptide sequence
RRKIGINNPRH

SEQ ID NO: 6691 - protein, 11 aa, Artificial
  IGFBP-2 heparin binding domain-containing peptide sequence
HRKIGINNPRH

SEQ ID NO: 6692 - protein, 11 aa, Artificial
  IGFBP-2 heparin binding domain-containing peptide sequence
KHRIGINNPRH

SEQ ID NO: 6693 - protein, 11 aa, Artificial
  IGFBP-2 heparin binding domain-containing peptide sequence
RHRIGINNPRH

SEQ ID NO: 6694 - protein, 11 aa, Artificial
  IGFBP-2 heparin binding domain-containing peptide sequence
HHRIGINNPRH

SEQ ID NO: 6695 - protein, 11 aa, Artificial
  IGFBP-2 heparin binding domain-containing peptide sequence
KKRIGINNPRH

SEQ ID NO: 6696 - protein, 11 aa, Artificial
  IGFBP-2 heparin binding domain-containing peptide sequence
RKRIGINNPRH

SEQ ID NO: 6697 - protein, 11 aa, Artificial
  IGFBP-2 heparin binding domain-containing peptide sequence
HKRIGINNPRH

SEQ ID NO: 6698 - protein, 11 aa, Artificial
  IGFBP-2 heparin binding domain-containing peptide sequence
KRRIGINNPRH

SEQ ID NO: 6699 - protein, 11 aa, Artificial
  IGFBP-2 heparin binding domain-containing peptide sequence
RRRIGINNPRH

SEQ ID NO: 6700 - protein, 11 aa, Artificial
  IGFBP-2 heparin binding domain-containing peptide sequence
HRRIGINNPRH

SEQ ID NO: 6701 - protein, 11 aa, Artificial
  IGFBP-2 heparin binding domain-containing peptide sequence
KHHVGINNPRH

SEQ ID NO: 6702 - protein, 11 aa, Artificial
  IGFBP-2 heparin binding domain-containing peptide sequence
RHHVGINNPRH

SEQ ID NO: 6703 - protein, 11 aa, Artificial
  IGFBP-2 heparin binding domain-containing peptide sequence
HHHVGINNPRH

SEQ ID NO: 6704 - protein, 11 aa, Artificial
  IGFBP-2 heparin binding domain-containing peptide sequence
KKHVGINNPRH

SEQ ID NO: 6705 - protein, 11 aa, Artificial
  IGFBP-2 heparin binding domain-containing peptide sequence
RKHVGINNPRH

SEQ ID NO: 6706 - protein, 11 aa, Artificial
  IGFBP-2 heparin binding domain-containing peptide sequence
HKHVGINNPRH

SEQ ID NO: 6707 - protein, 11 aa, Artificial
  IGFBP-2 heparin binding domain-containing peptide sequence
KRHVGINNPRH

SEQ ID NO: 6708 - protein, 11 aa, Artificial
  IGFBP-2 heparin binding domain-containing peptide sequence
RRHVGINNPRH

SEQ ID NO: 6709 - protein, 11 aa, Artificial
  IGFBP-2 heparin binding domain-containing peptide sequence
HRHVGINNPRH

SEQ ID NO: 6710 - protein, 11 aa, Artificial
  IGFBP-2 heparin binding domain-containing peptide sequence
KHKVGINNPRH

SEQ ID NO: 6711 - protein, 11 aa, Artificial
  IGFBP-2 heparin binding domain-containing peptide sequence
RHKVGINNPRH

SEQ ID NO: 6712 - protein, 11 aa, Artificial
  IGFBP-2 heparin binding domain-containing peptide sequence
HHKVGINNPRH

SEQ ID NO: 6713 - protein, 11 aa, Artificial
  IGFBP-2 heparin binding domain-containing peptide sequence
KKKVGINNPRH

SEQ ID NO: 6714 - protein, 11 aa, Artificial
  IGFBP-2 heparin binding domain-containing peptide sequence
RKKVGINNPRH

SEQ ID NO: 6715 - protein, 11 aa, Artificial
  IGFBP-2 heparin binding domain-containing peptide sequence
HKKVGINNPRH

SEQ ID NO: 6716 - protein, 11 aa, Artificial
  IGFBP-2 heparin binding domain-containing peptide sequence
KRKVGINNPRH

SEQ ID NO: 6717 - protein, 11 aa, Artificial
  IGFBP-2 heparin binding domain-containing peptide sequence
RRKVGINNPRH

SEQ ID NO: 6718 - protein, 11 aa, Artificial
  IGFBP-2 heparin binding domain-containing peptide sequence
HRKVGINNPRH

SEQ ID NO: 6719 - protein, 11 aa, Artificial
  IGFBP-2 heparin binding domain-containing peptide sequence
KHRVGINNPRH

SEQ ID NO: 6720 - protein, 11 aa, Artificial
  IGFBP-2 heparin binding domain-containing peptide sequence
RHRVGINNPRH

SEQ ID NO: 6721 - protein, 11 aa, Artificial
  IGFBP-2 heparin binding domain-containing peptide sequence
HHRVGINNPRH

SEQ ID NO: 6722 - protein, 11 aa, Artificial
  IGFBP-2 heparin binding domain-containing peptide sequence
KKRVGINNPRH

SEQ ID NO: 6723 - protein, 11 aa, Artificial
  IGFBP-2 heparin binding domain-containing peptide sequence
RKRVGINNPRH

SEQ ID NO: 6724 - protein, 11 aa, Artificial
  IGFBP-2 heparin binding domain-containing peptide sequence
HKRVGINNPRH

SEQ ID NO: 6725 - protein, 11 aa, Artificial
  IGFBP-2 heparin binding domain-containing peptide sequence
KRRVGINNPRH

SEQ ID NO: 6726 - protein, 11 aa, Artificial
  IGFBP-2 heparin binding domain-containing peptide sequence
RRRVGINNPRH

SEQ ID NO: 6727 - protein, 11 aa, Artificial
  IGFBP-2 heparin binding domain-containing peptide sequence
HRRVGINNPRH

SEQ ID NO: 6728 - protein, 11 aa, Artificial
  IGFBP-2 heparin binding domain-containing peptide sequence
KHHLGVNNPRH

SEQ ID NO: 6729 - protein, 11 aa, Artificial
  IGFBP-2 heparin binding domain-containing peptide sequence
RHHLGVNNPRH

SEQ ID NO: 6730 - protein, 11 aa, Artificial
  IGFBP-2 heparin binding domain-containing peptide sequence
HHHLGVNNPRH

SEQ ID NO: 6731 - protein, 11 aa, Artificial
  IGFBP-2 heparin binding domain-containing peptide sequence
KKHLGVNNPRH

SEQ ID NO: 6732 - protein, 11 aa, Artificial
  IGFBP-2 heparin binding domain-containing peptide sequence
RKHLGVNNPRH

SEQ ID NO: 6733 - protein, 11 aa, Artificial
  IGFBP-2 heparin binding domain-containing peptide sequence
HKHLGVNNPRH

SEQ ID NO: 6734 - protein, 11 aa, Artificial
  IGFBP-2 heparin binding domain-containing peptide sequence
KRHLGVNNPRH

SEQ ID NO: 6735 - protein, 11 aa, Artificial
  IGFBP-2 heparin binding domain-containing peptide sequence
RRHLGVNNPRH

SEQ ID NO: 6736 - protein, 11 aa, Artificial
  IGFBP-2 heparin binding domain-containing peptide sequence
HRHLGVNNPRH

SEQ ID NO: 6737 - protein, 11 aa, Artificial
  IGFBP-2 heparin binding domain-containing peptide sequence
KHKLGVNNPRH

SEQ ID NO: 6738 - protein, 11 aa, Artificial
  IGFBP-2 heparin binding domain-containing peptide sequence
RHKLGVNNPRH

SEQ ID NO: 6739 - protein, 11 aa, Artificial
  IGFBP-2 heparin binding domain-containing peptide sequence
HHKLGVNNPRH

SEQ ID NO: 6740 - protein, 11 aa, Artificial
  IGFBP-2 heparin binding domain-containing peptide sequence
KKKLGVNNPRH

SEQ ID NO: 6741 - protein, 11 aa, Artificial
  IGFBP-2 heparin binding domain-containing peptide sequence
RKKLGVNNPRH

SEQ ID NO: 6742 - protein, 11 aa, Artificial
  IGFBP-2 heparin binding domain-containing peptide sequence
HKKLGVNNPRH

SEQ ID NO: 6743 - protein, 11 aa, Artificial
  IGFBP-2 heparin binding domain-containing peptide sequence
KRKLGVNNPRH

SEQ ID NO: 6744 - protein, 11 aa, Artificial
  IGFBP-2 heparin binding domain-containing peptide sequence
RRKLGVNNPRH

SEQ ID NO: 6745 - protein, 11 aa, Artificial
  IGFBP-2 heparin binding domain-containing peptide sequence
HRKLGVNNPRH

SEQ ID NO: 6746 - protein, 11 aa, Artificial
  IGFBP-2 heparin binding domain-containing peptide sequence
KHRLGVNNPRH

SEQ ID NO: 6747 - protein, 11 aa, Artificial
  IGFBP-2 heparin binding domain-containing peptide sequence
RHRLGVNNPRH

SEQ ID NO: 6748 - protein, 11 aa, Artificial
  IGFBP-2 heparin binding domain-containing peptide sequence
HHRLGVNNPRH

SEQ ID NO: 6749 - protein, 11 aa, Artificial
  IGFBP-2 heparin binding domain-containing peptide sequence
KKRLGVNNPRH

SEQ ID NO: 6750 - protein, 11 aa, Artificial
  IGFBP-2 heparin binding domain-containing peptide sequence
RKRLGVNNPRH

SEQ ID NO: 6751 - protein, 11 aa, Artificial
  IGFBP-2 heparin binding domain-containing peptide sequence
HKRLGVNNPRH

SEQ ID NO: 6752 - protein, 11 aa, Artificial
  IGFBP-2 heparin binding domain-containing peptide sequence
KRRLGVNNPRH

SEQ ID NO: 6753 - protein, 11 aa, Artificial
  IGFBP-2 heparin binding domain-containing peptide sequence
RRRLGVNNPRH

SEQ ID NO: 6754 - protein, 11 aa, Artificial
  IGFBP-2 heparin binding domain-containing peptide sequence
HRRLGVNNPRH

SEQ ID NO: 6755 - protein, 11 aa, Artificial
  IGFBP-2 heparin binding domain-containing peptide sequence
KHHIGVNNPRH

SEQ ID NO: 6756 - protein, 11 aa, Artificial
  IGFBP-2 heparin binding domain-containing peptide sequence
RHHIGVNNPRH

SEQ ID NO: 6757 - protein, 11 aa, Artificial
  IGFBP-2 heparin binding domain-containing peptide sequence
HHHIGVNNPRH

SEQ ID NO: 6758 - protein, 11 aa, Artificial
  IGFBP-2 heparin binding domain-containing peptide sequence
KKHIGVNNPRH

SEQ ID NO: 6759 - protein, 11 aa, Artificial
  IGFBP-2 heparin binding domain-containing peptide sequence
RKHIGVNNPRH

SEQ ID NO: 6760 - protein, 11 aa, Artificial
  IGFBP-2 heparin binding domain-containing peptide sequence
HKHIGVNNPRH

SEQ ID NO: 6761 - protein, 11 aa, Artificial
  IGFBP-2 heparin binding domain-containing peptide sequence
KRHIGVNNPRH

SEQ ID NO: 6762 - protein, 11 aa, Artificial
  IGFBP-2 heparin binding domain-containing peptide sequence
RRHIGVNNPRH

SEQ ID NO: 6763 - protein, 11 aa, Artificial
  IGFBP-2 heparin binding domain-containing peptide sequence
HRHIGVNNPRH

SEQ ID NO: 6764 - protein, 11 aa, Artificial
  IGFBP-2 heparin binding domain-containing peptide sequence
KHKIGVNNPRH

SEQ ID NO: 6765 - protein, 11 aa, Artificial
  IGFBP-2 heparin binding domain-containing peptide sequence
RHKIGVNNPRH

SEQ ID NO: 6766 - protein, 11 aa, Artificial
  IGFBP-2 heparin binding domain-containing peptide sequence
HHKIGVNNPRH

SEQ ID NO: 6767 - protein, 11 aa, Artificial
  IGFBP-2 heparin binding domain-containing peptide sequence
KKKIGVNNPRH

SEQ ID NO: 6768 - protein, 11 aa, Artificial
  IGFBP-2 heparin binding domain-containing peptide sequence
RKKIGVNNPRH

SEQ ID NO: 6769 - protein, 11 aa, Artificial
  IGFBP-2 heparin binding domain-containing peptide sequence
HKKIGVNNPRH

SEQ ID NO: 6770 - protein, 11 aa, Artificial
  IGFBP-2 heparin binding domain-containing peptide sequence
KRKIGVNNPRH

SEQ ID NO: 6771 - protein, 11 aa, Artificial
  IGFBP-2 heparin binding domain-containing peptide sequence
RRKIGVNNPRH

SEQ ID NO: 6772 - protein, 11 aa, Artificial
  IGFBP-2 heparin binding domain-containing peptide sequence
HRKIGVNNPRH

SEQ ID NO: 6773 - protein, 11 aa, Artificial
  IGFBP-2 heparin binding domain-containing peptide sequence
KHRIGVNNPRH

SEQ ID NO: 6774 - protein, 11 aa, Artificial
  IGFBP-2 heparin binding domain-containing peptide sequence
RHRIGVNNPRH

SEQ ID NO: 6775 - protein, 11 aa, Artificial
  IGFBP-2 heparin binding domain-containing peptide sequence
HHRIGVNNPRH

SEQ ID NO: 6776 - protein, 11 aa, Artificial
  IGFBP-2 heparin binding domain-containing peptide sequence
KKRIGVNNPRH

SEQ ID NO: 6777 - protein, 11 aa, Artificial
  IGFBP-2 heparin binding domain-containing peptide sequence
RKRIGVNNPRH

SEQ ID NO: 6778 - protein, 11 aa, Artificial
  IGFBP-2 heparin binding domain-containing peptide sequence
HKRIGVNNPRH

SEQ ID NO: 6779 - protein, 11 aa, Artificial
  IGFBP-2 heparin binding domain-containing peptide sequence
KRRIGVNNPRH

SEQ ID NO: 6780 - protein, 11 aa, Artificial
  IGFBP-2 heparin binding domain-containing peptide sequence
RRRIGVNNPRH

SEQ ID NO: 6781 - protein, 11 aa, Artificial
  IGFBP-2 heparin binding domain-containing peptide sequence
HRRIGVNNPRH

SEQ ID NO: 6782 - protein, 11 aa, Artificial
  IGFBP-2 heparin binding domain-containing peptide sequence
KHHVGVNNPRH

SEQ ID NO: 6783 - protein, 11 aa, Artificial
  IGFBP-2 heparin binding domain-containing peptide sequence
RHHVGVNNPRH

SEQ ID NO: 6784 - protein, 11 aa, Artificial
  IGFBP-2 heparin binding domain-containing peptide sequence
HHHVGVNNPRH

SEQ ID NO: 6785 - protein, 11 aa, Artificial
  IGFBP-2 heparin binding domain-containing peptide sequence
KKHVGVNNPRH

SEQ ID NO: 6786 - protein, 11 aa, Artificial
  IGFBP-2 heparin binding domain-containing peptide sequence
RKHVGVNNPRH

SEQ ID NO: 6787 - protein, 11 aa, Artificial
  IGFBP-2 heparin binding domain-containing peptide sequence
HKHVGVNNPRH

SEQ ID NO: 6788 - protein, 11 aa, Artificial
  IGFBP-2 heparin binding domain-containing peptide sequence
KRHVGVNNPRH

SEQ ID NO: 6789 - protein, 11 aa, Artificial
  IGFBP-2 heparin binding domain-containing peptide sequence
RRHVGVNNPRH

SEQ ID NO: 6790 - protein, 11 aa, Artificial
  IGFBP-2 heparin binding domain-containing peptide sequence
HRHVGVNNPRH

SEQ ID NO: 6791 - protein, 11 aa, Artificial
  IGFBP-2 heparin binding domain-containing peptide sequence
KHKVGVNNPRH

SEQ ID NO: 6792 - protein, 11 aa, Artificial
  IGFBP-2 heparin binding domain-containing peptide sequence
RHKVGVNNPRH

SEQ ID NO: 6793 - protein, 11 aa, Artificial
  IGFBP-2 heparin binding domain-containing peptide sequence
HHKVGVNNPRH

SEQ ID NO: 6794 - protein, 11 aa, Artificial
  IGFBP-2 heparin binding domain-containing peptide sequence
KKKVGVNNPRH

SEQ ID NO: 6795 - protein, 11 aa, Artificial
  IGFBP-2 heparin binding domain-containing peptide sequence
RKKVGVNNPRH

SEQ ID NO: 6796 - protein, 11 aa, Artificial
  IGFBP-2 heparin binding domain-containing peptide sequence
HKKVGVNNPRH

SEQ ID NO: 6797 - protein, 11 aa, Artificial
  IGFBP-2 heparin binding domain-containing peptide sequence
KRKVGVNNPRH

SEQ ID NO: 6798 - protein, 11 aa, Artificial
  IGFBP-2 heparin binding domain-containing peptide sequence
RRKVGVNNPRH

SEQ ID NO: 6799 - protein, 11 aa, Artificial
  IGFBP-2 heparin binding domain-containing peptide sequence
HRKVGVNNPRH

SEQ ID NO: 6800 - protein, 11 aa, Artificial
  IGFBP-2 heparin binding domain-containing peptide sequence
KHRVGVNNPRH

SEQ ID NO: 6801 - protein, 11 aa, Artificial
  IGFBP-2 heparin binding domain-containing peptide sequence
RHRVGVNNPRH

SEQ ID NO: 6802 - protein, 11 aa, Artificial
  IGFBP-2 heparin binding domain-containing peptide sequence
HHRVGVNNPRH

SEQ ID NO: 6803 - protein, 11 aa, Artificial
  IGFBP-2 heparin binding domain-containing peptide sequence
KKRVGVNNPRH

SEQ ID NO: 6804 - protein, 11 aa, Artificial
  IGFBP-2 heparin binding domain-containing peptide sequence
RKRVGVNNPRH

SEQ ID NO: 6805 - protein, 11 aa, Artificial
  IGFBP-2 heparin binding domain-containing peptide sequence
HKRVGVNNPRH

SEQ ID NO: 6806 - protein, 11 aa, Artificial
  IGFBP-2 heparin binding domain-containing peptide sequence
KRRVGVNNPRH

SEQ ID NO: 6807 - protein, 11 aa, Artificial
  IGFBP-2 heparin binding domain-containing peptide sequence
RRRVGVNNPRH

SEQ ID NO: 6808 - protein, 11 aa, Artificial
  IGFBP-2 heparin binding domain-containing peptide sequence
HRRVGVNNPRH

SEQ ID NO: 6809 - protein, 11 aa, Artificial
  IGFBP-2 heparin binding domain-containing peptide sequence
KHHLGLEEPHR

SEQ ID NO: 6810 - protein, 11 aa, Artificial
  IGFBP-2 heparin binding domain-containing peptide sequence
RHHLGLEEPHR

SEQ ID NO: 6811 - protein, 11 aa, Artificial
  IGFBP-2 heparin binding domain-containing peptide sequence
HHHLGLEEPHR

SEQ ID NO: 6812 - protein, 11 aa, Artificial
  IGFBP-2 heparin binding domain-containing peptide sequence
KKHLGLEEPHR

SEQ ID NO: 6813 - protein, 11 aa, Artificial
  IGFBP-2 heparin binding domain-containing peptide sequence
RKHLGLEEPHR

SEQ ID NO: 6814 - protein, 11 aa, Artificial
  IGFBP-2 heparin binding domain-containing peptide sequence
HKHLGLEEPHR

SEQ ID NO: 6815 - protein, 11 aa, Artificial
  IGFBP-2 heparin binding domain-containing peptide sequence
KRHLGLEEPHR

SEQ ID NO: 6816 - protein, 11 aa, Artificial
  IGFBP-2 heparin binding domain-containing peptide sequence
RRHLGLEEPHR

SEQ ID NO: 6817 - protein, 11 aa, Artificial
  IGFBP-2 heparin binding domain-containing peptide sequence
HRHLGLEEPHR

SEQ ID NO: 6818 - protein, 11 aa, Artificial
  IGFBP-2 heparin binding domain-containing peptide sequence
KHKLGLEEPHR

SEQ ID NO: 6819 - protein, 11 aa, Artificial
  IGFBP-2 heparin binding domain-containing peptide sequence
RHKLGLEEPHR

SEQ ID NO: 6820 - protein, 11 aa, Artificial
  IGFBP-2 heparin binding domain-containing peptide sequence
HHKLGLEEPHR

SEQ ID NO: 6821 - protein, 11 aa, Artificial
  IGFBP-2 heparin binding domain-containing peptide sequence
KKKLGLEEPHR

SEQ ID NO: 6822 - protein, 11 aa, Artificial
  IGFBP-2 heparin binding domain-containing peptide sequence
RKKLGLEEPHR

SEQ ID NO: 6823 - protein, 11 aa, Artificial
  IGFBP-2 heparin binding domain-containing peptide sequence
HKKLGLEEPHR

SEQ ID NO: 6824 - protein, 11 aa, Artificial
  IGFBP-2 heparin binding domain-containing peptide sequence
KRKLGLEEPHR

SEQ ID NO: 6825 - protein, 11 aa, Artificial
  IGFBP-2 heparin binding domain-containing peptide sequence
RRKLGLEEPHR

SEQ ID NO: 6826 - protein, 11 aa, Artificial
  IGFBP-2 heparin binding domain-containing peptide sequence
HRKLGLEEPHR

SEQ ID NO: 6827 - protein, 11 aa, Artificial
  IGFBP-2 heparin binding domain-containing peptide sequence
KHRLGLEEPHR

SEQ ID NO: 6828 - protein, 11 aa, Artificial
  IGFBP-2 heparin binding domain-containing peptide sequence
RHRLGLEEPHR

SEQ ID NO: 6829 - protein, 11 aa, Artificial
  IGFBP-2 heparin binding domain-containing peptide sequence
HHRLGLEEPHR

SEQ ID NO: 6830 - protein, 11 aa, Artificial
  IGFBP-2 heparin binding domain-containing peptide sequence
KKRLGLEEPHR

SEQ ID NO: 6831 - protein, 11 aa, Artificial
  IGFBP-2 heparin binding domain-containing peptide sequence
RKRLGLEEPHR

SEQ ID NO: 6832 - protein, 11 aa, Artificial
  IGFBP-2 heparin binding domain-containing peptide sequence
HKRLGLEEPHR

SEQ ID NO: 6833 - protein, 11 aa, Artificial
  IGFBP-2 heparin binding domain-containing peptide sequence
KRRLGLEEPHR

SEQ ID NO: 6834 - protein, 11 aa, Artificial
  IGFBP-2 heparin binding domain-containing peptide sequence
RRRLGLEEPHR

SEQ ID NO: 6835 - protein, 11 aa, Artificial
  IGFBP-2 heparin binding domain-containing peptide sequence
HRRLGLEEPHR

SEQ ID NO: 6836 - protein, 11 aa, Artificial
  IGFBP-2 heparin binding domain-containing peptide sequence
KHHIGLEEPHR

SEQ ID NO: 6837 - protein, 11 aa, Artificial
  IGFBP-2 heparin binding domain-containing peptide sequence
RHHIGLEEPHR

SEQ ID NO: 6838 - protein, 11 aa, Artificial
  IGFBP-2 heparin binding domain-containing peptide sequence
HHHIGLEEPHR

SEQ ID NO: 6839 - protein, 11 aa, Artificial
  IGFBP-2 heparin binding domain-containing peptide sequence
KKHIGLEEPHR

SEQ ID NO: 6840 - protein, 11 aa, Artificial
  IGFBP-2 heparin binding domain-containing peptide sequence
RKHIGLEEPHR

SEQ ID NO: 6841 - protein, 11 aa, Artificial
  IGFBP-2 heparin binding domain-containing peptide sequence
HKHIGLEEPHR

SEQ ID NO: 6842 - protein, 11 aa, Artificial
  IGFBP-2 heparin binding domain-containing peptide sequence
KRHIGLEEPHR

SEQ ID NO: 6843 - protein, 11 aa, Artificial
  IGFBP-2 heparin binding domain-containing peptide sequence
RRHIGLEEPHR

SEQ ID NO: 6844 - protein, 11 aa, Artificial
  IGFBP-2 heparin binding domain-containing peptide sequence
HRHIGLEEPHR

SEQ ID NO: 6845 - protein, 11 aa, Artificial
  IGFBP-2 heparin binding domain-containing peptide sequence
KHKIGLEEPHR

SEQ ID NO: 6846 - protein, 11 aa, Artificial
  IGFBP-2 heparin binding domain-containing peptide sequence
RHKIGLEEPHR

SEQ ID NO: 6847 - protein, 11 aa, Artificial
  IGFBP-2 heparin binding domain-containing peptide sequence
HHKIGLEEPHR

SEQ ID NO: 6848 - protein, 11 aa, Artificial
  IGFBP-2 heparin binding domain-containing peptide sequence
KKKIGLEEPHR

SEQ ID NO: 6849 - protein, 11 aa, Artificial
  IGFBP-2 heparin binding domain-containing peptide sequence
RKKIGLEEPHR

SEQ ID NO: 6850 - protein, 11 aa, Artificial
  IGFBP-2 heparin binding domain-containing peptide sequence
HKKIGLEEPHR

SEQ ID NO: 6851 - protein, 11 aa, Artificial
  IGFBP-2 heparin binding domain-containing peptide sequence
KRKIGLEEPHR

SEQ ID NO: 6852 - protein, 11 aa, Artificial
  IGFBP-2 heparin binding domain-containing peptide sequence
RRKIGLEEPHR

SEQ ID NO: 6853 - protein, 11 aa, Artificial
  IGFBP-2 heparin binding domain-containing peptide sequence
HRKIGLEEPHR

SEQ ID NO: 6854 - protein, 11 aa, Artificial
  IGFBP-2 heparin binding domain-containing peptide sequence
KHRIGLEEPHR

SEQ ID NO: 6855 - protein, 11 aa, Artificial
  IGFBP-2 heparin binding domain-containing peptide sequence
RHRIGLEEPHR

SEQ ID NO: 6856 - protein, 11 aa, Artificial
  IGFBP-2 heparin binding domain-containing peptide sequence
HHRIGLEEPHR

SEQ ID NO: 6857 - protein, 11 aa, Artificial
  IGFBP-2 heparin binding domain-containing peptide sequence
KKRIGLEEPHR

SEQ ID NO: 6858 - protein, 11 aa, Artificial
  IGFBP-2 heparin binding domain-containing peptide sequence
RKRIGLEEPHR

SEQ ID NO: 6859 - protein, 11 aa, Artificial
  IGFBP-2 heparin binding domain-containing peptide sequence
HKRIGLEEPHR

SEQ ID NO: 6860 - protein, 11 aa, Artificial
  IGFBP-2 heparin binding domain-containing peptide sequence
KRRIGLEEPHR

SEQ ID NO: 6861 - protein, 11 aa, Artificial
  IGFBP-2 heparin binding domain-containing peptide sequence
RRRIGLEEPHR

SEQ ID NO: 6862 - protein, 11 aa, Artificial
  IGFBP-2 heparin binding domain-containing peptide sequence
HRRIGLEEPHR

SEQ ID NO: 6863 - protein, 11 aa, Artificial
  IGFBP-2 heparin binding domain-containing peptide sequence
KHHVGLEEPHR

SEQ ID NO: 6864 - protein, 11 aa, Artificial
  IGFBP-2 heparin binding domain-containing peptide sequence
RHHVGLEEPHR

SEQ ID NO: 6865 - protein, 11 aa, Artificial
  IGFBP-2 heparin binding domain-containing peptide sequence
HHHVGLEEPHR

SEQ ID NO: 6866 - protein, 11 aa, Artificial
  IGFBP-2 heparin binding domain-containing peptide sequence
KKHVGLEEPHR

SEQ ID NO: 6867 - protein, 11 aa, Artificial
  IGFBP-2 heparin binding domain-containing peptide sequence
RKHVGLEEPHR

SEQ ID NO: 6868 - protein, 11 aa, Artificial
  IGFBP-2 heparin binding domain-containing peptide sequence
HKHVGLEEPHR

SEQ ID NO: 6869 - protein, 11 aa, Artificial
  IGFBP-2 heparin binding domain-containing peptide sequence
KRHVGLEEPHR

SEQ ID NO: 6870 - protein, 11 aa, Artificial
  IGFBP-2 heparin binding domain-containing peptide sequence
RRHVGLEEPHR

SEQ ID NO: 6871 - protein, 11 aa, Artificial
  IGFBP-2 heparin binding domain-containing peptide sequence
HRHVGLEEPHR

SEQ ID NO: 6872 - protein, 11 aa, Artificial
  IGFBP-2 heparin binding domain-containing peptide sequence
KHKVGLEEPHR

SEQ ID NO: 6873 - protein, 11 aa, Artificial
  IGFBP-2 heparin binding domain-containing peptide sequence
RHKVGLEEPHR

SEQ ID NO: 6874 - protein, 11 aa, Artificial
  IGFBP-2 heparin binding domain-containing peptide sequence
HHKVGLEEPHR

SEQ ID NO: 6875 - protein, 11 aa, Artificial
  IGFBP-2 heparin binding domain-containing peptide sequence
KKKVGLEEPHR

SEQ ID NO: 6876 - protein, 11 aa, Artificial
  IGFBP-2 heparin binding domain-containing peptide sequence
RKKVGLEEPHR

SEQ ID NO: 6877 - protein, 11 aa, Artificial
  IGFBP-2 heparin binding domain-containing peptide sequence
HKKVGLEEPHR

SEQ ID NO: 6878 - protein, 11 aa, Artificial
  IGFBP-2 heparin binding domain-containing peptide sequence
KRKVGLEEPHR

SEQ ID NO: 6879 - protein, 11 aa, Artificial
  IGFBP-2 heparin binding domain-containing peptide sequence
RRKVGLEEPHR

SEQ ID NO: 6880 - protein, 11 aa, Artificial
  IGFBP-2 heparin binding domain-containing peptide sequence
HRKVGLEEPHR

SEQ ID NO: 6881 - protein, 11 aa, Artificial
  IGFBP-2 heparin binding domain-containing peptide sequence
KHRVGLEEPHR

SEQ ID NO: 6882 - protein, 11 aa, Artificial
  IGFBP-2 heparin binding domain-containing peptide sequence
RHRVGLEEPHR

SEQ ID NO: 6883 - protein, 11 aa, Artificial
  IGFBP-2 heparin binding domain-containing peptide sequence
HHRVGLEEPHR

SEQ ID NO: 6884 - protein, 11 aa, Artificial
  IGFBP-2 heparin binding domain-containing peptide sequence
KKRVGLEEPHR

SEQ ID NO: 6885 - protein, 11 aa, Artificial
  IGFBP-2 heparin binding domain-containing peptide sequence
RKRVGLEEPHR

SEQ ID NO: 6886 - protein, 11 aa, Artificial
  IGFBP-2 heparin binding domain-containing peptide sequence
HKRVGLEEPHR

SEQ ID NO: 6887 - protein, 11 aa, Artificial
  IGFBP-2 heparin binding domain-containing peptide sequence
KRRVGLEEPHR

SEQ ID NO: 6888 - protein, 11 aa, Artificial
  IGFBP-2 heparin binding domain-containing peptide sequence
RRRVGLEEPHR

SEQ ID NO: 6889 - protein, 11 aa, Artificial
  IGFBP-2 heparin binding domain-containing peptide sequence
HRRVGLEEPHR

SEQ ID NO: 6890 - protein, 11 aa, Artificial
  IGFBP-2 heparin binding domain-containing peptide sequence
KHHLGIEEPHR

SEQ ID NO: 6891 - protein, 11 aa, Artificial
  IGFBP-2 heparin binding domain-containing peptide sequence
RHHLGIEEPHR

SEQ ID NO: 6892 - protein, 11 aa, Artificial
  IGFBP-2 heparin binding domain-containing peptide sequence
HHHLGIEEPHR

SEQ ID NO: 6893 - protein, 11 aa, Artificial
  IGFBP-2 heparin binding domain-containing peptide sequence
KKHLGIEEPHR

SEQ ID NO: 6894 - protein, 11 aa, Artificial
  IGFBP-2 heparin binding domain-containing peptide sequence
RKHLGIEEPHR

SEQ ID NO: 6895 - protein, 11 aa, Artificial
  IGFBP-2 heparin binding domain-containing peptide sequence
HKHLGIEEPHR

SEQ ID NO: 6896 - protein, 11 aa, Artificial
  IGFBP-2 heparin binding domain-containing peptide sequence
KRHLGIEEPHR

SEQ ID NO: 6897 - protein, 11 aa, Artificial
  IGFBP-2 heparin binding domain-containing peptide sequence
RRHLGIEEPHR

SEQ ID NO: 6898 - protein, 11 aa, Artificial
  IGFBP-2 heparin binding domain-containing peptide sequence
HRHLGIEEPHR

SEQ ID NO: 6899 - protein, 11 aa, Artificial
  IGFBP-2 heparin binding domain-containing peptide sequence
KHKLGIEEPHR

SEQ ID NO: 6900 - protein, 11 aa, Artificial
  IGFBP-2 heparin binding domain-containing peptide sequence
RHKLGIEEPHR

SEQ ID NO: 6901 - protein, 11 aa, Artificial
  IGFBP-2 heparin binding domain-containing peptide sequence
HHKLGIEEPHR

SEQ ID NO: 6902 - protein, 11 aa, Artificial
  IGFBP-2 heparin binding domain-containing peptide sequence
KKKLGIEEPHR

SEQ ID NO: 6903 - protein, 11 aa, Artificial
  IGFBP-2 heparin binding domain-containing peptide sequence
RKKLGIEEPHR

SEQ ID NO: 6904 - protein, 11 aa, Artificial
  IGFBP-2 heparin binding domain-containing peptide sequence
HKKLGIEEPHR

SEQ ID NO: 6905 - protein, 11 aa, Artificial
  IGFBP-2 heparin binding domain-containing peptide sequence
KRKLGIEEPHR

SEQ ID NO: 6906 - protein, 11 aa, Artificial
  IGFBP-2 heparin binding domain-containing peptide sequence
RRKLGIEEPHR

SEQ ID NO: 6907 - protein, 11 aa, Artificial
  IGFBP-2 heparin binding domain-containing peptide sequence
HRKLGIEEPHR

SEQ ID NO: 6908 - protein, 11 aa, Artificial
  IGFBP-2 heparin binding domain-containing peptide sequence
KHRLGIEEPHR

SEQ ID NO: 6909 - protein, 11 aa, Artificial
  IGFBP-2 heparin binding domain-containing peptide sequence
RHRLGIEEPHR

SEQ ID NO: 6910 - protein, 11 aa, Artificial
  IGFBP-2 heparin binding domain-containing peptide sequence
HHRLGIEEPHR

SEQ ID NO: 6911 - protein, 11 aa, Artificial
  IGFBP-2 heparin binding domain-containing peptide sequence
KKRLGIEEPHR

SEQ ID NO: 6912 - protein, 11 aa, Artificial
  IGFBP-2 heparin binding domain-containing peptide sequence
RKRLGIEEPHR

SEQ ID NO: 6913 - protein, 11 aa, Artificial
  IGFBP-2 heparin binding domain-containing peptide sequence
HKRLGIEEPHR

SEQ ID NO: 6914 - protein, 11 aa, Artificial
  IGFBP-2 heparin binding domain-containing peptide sequence
KRRLGIEEPHR

SEQ ID NO: 6915 - protein, 11 aa, Artificial
  IGFBP-2 heparin binding domain-containing peptide sequence
RRRLGIEEPHR

SEQ ID NO: 6916 - protein, 11 aa, Artificial
  IGFBP-2 heparin binding domain-containing peptide sequence
HRRLGIEEPHR

SEQ ID NO: 6917 - protein, 11 aa, Artificial
  IGFBP-2 heparin binding domain-containing peptide sequence
KHHIGIEEPHR

SEQ ID NO: 6918 - protein, 11 aa, Artificial
  IGFBP-2 heparin binding domain-containing peptide sequence
RHHIGIEEPHR

SEQ ID NO: 6919 - protein, 11 aa, Artificial
  IGFBP-2 heparin binding domain-containing peptide sequence
HHHIGIEEPHR

SEQ ID NO: 6920 - protein, 11 aa, Artificial
  IGFBP-2 heparin binding domain-containing peptide sequence
KKHIGIEEPHR

SEQ ID NO: 6921 - protein, 11 aa, Artificial
  IGFBP-2 heparin binding domain-containing peptide sequence
RKHIGIEEPHR

SEQ ID NO: 6922 - protein, 11 aa, Artificial
  IGFBP-2 heparin binding domain-containing peptide sequence
HKHIGIEEPHR

SEQ ID NO: 6923 - protein, 11 aa, Artificial
  IGFBP-2 heparin binding domain-containing peptide sequence
KRHIGIEEPHR

SEQ ID NO: 6924 - protein, 11 aa, Artificial
  IGFBP-2 heparin binding domain-containing peptide sequence
RRHIGIEEPHR

SEQ ID NO: 6925 - protein, 11 aa, Artificial
  IGFBP-2 heparin binding domain-containing peptide sequence
HRHIGIEEPHR

SEQ ID NO: 6926 - protein, 11 aa, Artificial
  IGFBP-2 heparin binding domain-containing peptide sequence
KHKIGIEEPHR

SEQ ID NO: 6927 - protein, 11 aa, Artificial
  IGFBP-2 heparin binding domain-containing peptide sequence
RHKIGIEEPHR

SEQ ID NO: 6928 - protein, 11 aa, Artificial
  IGFBP-2 heparin binding domain-containing peptide sequence
HHKIGIEEPHR

SEQ ID NO: 6929 - protein, 11 aa, Artificial
  IGFBP-2 heparin binding domain-containing peptide sequence
KKKIGIEEPHR

SEQ ID NO: 6930 - protein, 11 aa, Artificial
  IGFBP-2 heparin binding domain-containing peptide sequence
RKKIGIEEPHR

SEQ ID NO: 6931 - protein, 11 aa, Artificial
  IGFBP-2 heparin binding domain-containing peptide sequence
HKKIGIEEPHR

SEQ ID NO: 6932 - protein, 11 aa, Artificial
  IGFBP-2 heparin binding domain-containing peptide sequence
KRKIGIEEPHR

SEQ ID NO: 6933 - protein, 11 aa, Artificial
  IGFBP-2 heparin binding domain-containing peptide sequence
RRKIGIEEPHR

SEQ ID NO: 6934 - protein, 11 aa, Artificial
  IGFBP-2 heparin binding domain-containing peptide sequence
HRKIGIEEPHR

SEQ ID NO: 6935 - protein, 11 aa, Artificial
  IGFBP-2 heparin binding domain-containing peptide sequence
KHRIGIEEPHR

SEQ ID NO: 6936 - protein, 11 aa, Artificial
  IGFBP-2 heparin binding domain-containing peptide sequence
RHRIGIEEPHR

SEQ ID NO: 6937 - protein, 11 aa, Artificial
  IGFBP-2 heparin binding domain-containing peptide sequence
HHRIGIEEPHR

SEQ ID NO: 6938 - protein, 11 aa, Artificial
  IGFBP-2 heparin binding domain-containing peptide sequence
KKRIGIEEPHR

SEQ ID NO: 6939 - protein, 11 aa, Artificial
  IGFBP-2 heparin binding domain-containing peptide sequence
RKRIGIEEPHR

SEQ ID NO: 6940 - protein, 11 aa, Artificial
  IGFBP-2 heparin binding domain-containing peptide sequence
HKRIGIEEPHR

SEQ ID NO: 6941 - protein, 11 aa, Artificial
  IGFBP-2 heparin binding domain-containing peptide sequence
KRRIGIEEPHR

SEQ ID NO: 6942 - protein, 11 aa, Artificial
  IGFBP-2 heparin binding domain-containing peptide sequence
RRRIGIEEPHR

SEQ ID NO: 6943 - protein, 11 aa, Artificial
  IGFBP-2 heparin binding domain-containing peptide sequence
HRRIGIEEPHR

SEQ ID NO: 6944 - protein, 11 aa, Artificial
  IGFBP-2 heparin binding domain-containing peptide sequence
KHHVGIEEPHR

SEQ ID NO: 6945 - protein, 11 aa, Artificial
  IGFBP-2 heparin binding domain-containing peptide sequence
RHHVGIEEPHR

SEQ ID NO: 6946 - protein, 11 aa, Artificial
  IGFBP-2 heparin binding domain-containing peptide sequence
HHHVGIEEPHR

SEQ ID NO: 6947 - protein, 11 aa, Artificial
  IGFBP-2 heparin binding domain-containing peptide sequence
KKHVGIEEPHR

SEQ ID NO: 6948 - protein, 11 aa, Artificial
  IGFBP-2 heparin binding domain-containing peptide sequence
RKHVGIEEPHR

SEQ ID NO: 6949 - protein, 11 aa, Artificial
  IGFBP-2 heparin binding domain-containing peptide sequence
HKHVGIEEPHR

SEQ ID NO: 6950 - protein, 11 aa, Artificial
  IGFBP-2 heparin binding domain-containing peptide sequence
KRHVGIEEPHR

SEQ ID NO: 6951 - protein, 11 aa, Artificial
  IGFBP-2 heparin binding domain-containing peptide sequence
RRHVGIEEPHR

SEQ ID NO: 6952 - protein, 11 aa, Artificial
  IGFBP-2 heparin binding domain-containing peptide sequence
HRHVGIEEPHR

SEQ ID NO: 6953 - protein, 11 aa, Artificial
  IGFBP-2 heparin binding domain-containing peptide sequence
KHKVGIEEPHR

SEQ ID NO: 6954 - protein, 11 aa, Artificial
  IGFBP-2 heparin binding domain-containing peptide sequence
RHKVGIEEPHR

SEQ ID NO: 6955 - protein, 11 aa, Artificial
  IGFBP-2 heparin binding domain-containing peptide sequence
HHKVGIEEPHR

SEQ ID NO: 6956 - protein, 11 aa, Artificial
  IGFBP-2 heparin binding domain-containing peptide sequence
KKKVGIEEPHR

SEQ ID NO: 6957 - protein, 11 aa, Artificial
  IGFBP-2 heparin binding domain-containing peptide sequence
RKKVGIEEPHR

SEQ ID NO: 6958 - protein, 11 aa, Artificial
  IGFBP-2 heparin binding domain-containing peptide sequence
HKKVGIEEPHR

SEQ ID NO: 6959 - protein, 11 aa, Artificial
  IGFBP-2 heparin binding domain-containing peptide sequence
KRKVGIEEPHR

SEQ ID NO: 6960 - protein, 11 aa, Artificial
  IGFBP-2 heparin binding domain-containing peptide sequence
RRKVGIEEPHR

SEQ ID NO: 6961 - protein, 11 aa, Artificial
  IGFBP-2 heparin binding domain-containing peptide sequence
HRKVGIEEPHR

SEQ ID NO: 6962 - protein, 11 aa, Artificial
  IGFBP-2 heparin binding domain-containing peptide sequence
KHRVGIEEPHR

SEQ ID NO: 6963 - protein, 11 aa, Artificial
  IGFBP-2 heparin binding domain-containing peptide sequence
RHRVGIEEPHR

SEQ ID NO: 6964 - protein, 11 aa, Artificial
  IGFBP-2 heparin binding domain-containing peptide sequence
HHRVGIEEPHR

SEQ ID NO: 6965 - protein, 11 aa, Artificial
  IGFBP-2 heparin binding domain-containing peptide sequence
KKRVGIEEPHR

SEQ ID NO: 6966 - protein, 11 aa, Artificial
  IGFBP-2 heparin binding domain-containing peptide sequence
RKRVGIEEPHR

SEQ ID NO: 6967 - protein, 11 aa, Artificial
  IGFBP-2 heparin binding domain-containing peptide sequence
HKRVGIEEPHR

SEQ ID NO: 6968 - protein, 11 aa, Artificial
  IGFBP-2 heparin binding domain-containing peptide sequence
KRRVGIEEPHR

SEQ ID NO: 6969 - protein, 11 aa, Artificial
  IGFBP-2 heparin binding domain-containing peptide sequence
RRRVGIEEPHR

SEQ ID NO: 6970 - protein, 11 aa, Artificial
  IGFBP-2 heparin binding domain-containing peptide sequence
HRRVGIEEPHR

SEQ ID NO: 6971 - protein, 11 aa, Artificial
  IGFBP-2 heparin binding domain-containing peptide sequence
KHHLGVEEPHR

SEQ ID NO: 6972 - protein, 11 aa, Artificial
  IGFBP-2 heparin binding domain-containing peptide sequence
RHHLGVEEPHR

SEQ ID NO: 6973 - protein, 11 aa, Artificial
  IGFBP-2 heparin binding domain-containing peptide sequence
HHHLGVEEPHR

SEQ ID NO: 6974 - protein, 11 aa, Artificial
  IGFBP-2 heparin binding domain-containing peptide sequence
KKHLGVEEPHR

SEQ ID NO: 6975 - protein, 11 aa, Artificial
  IGFBP-2 heparin binding domain-containing peptide sequence
RKHLGVEEPHR

SEQ ID NO: 6976 - protein, 11 aa, Artificial
  IGFBP-2 heparin binding domain-containing peptide sequence
HKHLGVEEPHR

SEQ ID NO: 6977 - protein, 11 aa, Artificial
  IGFBP-2 heparin binding domain-containing peptide sequence
KRHLGVEEPHR

SEQ ID NO: 6978 - protein, 11 aa, Artificial
  IGFBP-2 heparin binding domain-containing peptide sequence
RRHLGVEEPHR

SEQ ID NO: 6979 - protein, 11 aa, Artificial
  IGFBP-2 heparin binding domain-containing peptide sequence
HRHLGVEEPHR

SEQ ID NO: 6980 - protein, 11 aa, Artificial
  IGFBP-2 heparin binding domain-containing peptide sequence
KHKLGVEEPHR

SEQ ID NO: 6981 - protein, 11 aa, Artificial
  IGFBP-2 heparin binding domain-containing peptide sequence
RHKLGVEEPHR

SEQ ID NO: 6982 - protein, 11 aa, Artificial
  IGFBP-2 heparin binding domain-containing peptide sequence
HHKLGVEEPHR

SEQ ID NO: 6983 - protein, 11 aa, Artificial
  IGFBP-2 heparin binding domain-containing peptide sequence
KKKLGVEEPHR

SEQ ID NO: 6984 - protein, 11 aa, Artificial
  IGFBP-2 heparin binding domain-containing peptide sequence
RKKLGVEEPHR

SEQ ID NO: 6985 - protein, 11 aa, Artificial
  IGFBP-2 heparin binding domain-containing peptide sequence
HKKLGVEEPHR

SEQ ID NO: 6986 - protein, 11 aa, Artificial
  IGFBP-2 heparin binding domain-containing peptide sequence
KRKLGVEEPHR

SEQ ID NO: 6987 - protein, 11 aa, Artificial
  IGFBP-2 heparin binding domain-containing peptide sequence
RRKLGVEEPHR

SEQ ID NO: 6988 - protein, 11 aa, Artificial
  IGFBP-2 heparin binding domain-containing peptide sequence
HRKLGVEEPHR

SEQ ID NO: 6989 - protein, 11 aa, Artificial
  IGFBP-2 heparin binding domain-containing peptide sequence
KHRLGVEEPHR

SEQ ID NO: 6990 - protein, 11 aa, Artificial
  IGFBP-2 heparin binding domain-containing peptide sequence
RHRLGVEEPHR

SEQ ID NO: 6991 - protein, 11 aa, Artificial
  IGFBP-2 heparin binding domain-containing peptide sequence
HHRLGVEEPHR

SEQ ID NO: 6992 - protein, 11 aa, Artificial
  IGFBP-2 heparin binding domain-containing peptide sequence
KKRLGVEEPHR

SEQ ID NO: 6993 - protein, 11 aa, Artificial
  IGFBP-2 heparin binding domain-containing peptide sequence
RKRLGVEEPHR

SEQ ID NO: 6994 - protein, 11 aa, Artificial
  IGFBP-2 heparin binding domain-containing peptide sequence
HKRLGVEEPHR

SEQ ID NO: 6995 - protein, 11 aa, Artificial
  IGFBP-2 heparin binding domain-containing peptide sequence
KRRLGVEEPHR

SEQ ID NO: 6996 - protein, 11 aa, Artificial
  IGFBP-2 heparin binding domain-containing peptide sequence
RRRLGVEEPHR

SEQ ID NO: 6997 - protein, 11 aa, Artificial
  IGFBP-2 heparin binding domain-containing peptide sequence
HRRLGVEEPHR

SEQ ID NO: 6998 - protein, 11 aa, Artificial
  IGFBP-2 heparin binding domain-containing peptide sequence
KHHIGVEEPHR

SEQ ID NO: 6999 - protein, 11 aa, Artificial
  IGFBP-2 heparin binding domain-containing peptide sequence
RHHIGVEEPHR

SEQ ID NO: 7000 - protein, 11 aa, Artificial
  IGFBP-2 heparin binding domain-containing peptide sequence
HHHIGVEEPHR

SEQ ID NO: 7001 - protein, 11 aa, Artificial
  IGFBP-2 heparin binding domain-containing peptide sequence
KKHIGVEEPHR

SEQ ID NO: 7002 - protein, 11 aa, Artificial
  IGFBP-2 heparin binding domain-containing peptide sequence
RKHIGVEEPHR

SEQ ID NO: 7003 - protein, 11 aa, Artificial
  IGFBP-2 heparin binding domain-containing peptide sequence
HKHIGVEEPHR

SEQ ID NO: 7004 - protein, 11 aa, Artificial
  IGFBP-2 heparin binding domain-containing peptide sequence
KRHIGVEEPHR

SEQ ID NO: 7005 - protein, 11 aa, Artificial
  IGFBP-2 heparin binding domain-containing peptide sequence
RRHIGVEEPHR

SEQ ID NO: 7006 - protein, 11 aa, Artificial
  IGFBP-2 heparin binding domain-containing peptide sequence
HRHIGVEEPHR

SEQ ID NO: 7007 - protein, 11 aa, Artificial
  IGFBP-2 heparin binding domain-containing peptide sequence
KHKIGVEEPHR

SEQ ID NO: 7008 - protein, 11 aa, Artificial
  IGFBP-2 heparin binding domain-containing peptide sequence
RHKIGVEEPHR

SEQ ID NO: 7009 - protein, 11 aa, Artificial
  IGFBP-2 heparin binding domain-containing peptide sequence
HHKIGVEEPHR

SEQ ID NO: 7010 - protein, 11 aa, Artificial
  IGFBP-2 heparin binding domain-containing peptide sequence
KKKIGVEEPHR

SEQ ID NO: 7011 - protein, 11 aa, Artificial
  IGFBP-2 heparin binding domain-containing peptide sequence
RKKIGVEEPHR

SEQ ID NO: 7012 - protein, 11 aa, Artificial
  IGFBP-2 heparin binding domain-containing peptide sequence
HKKIGVEEPHR

SEQ ID NO: 7013 - protein, 11 aa, Artificial
  IGFBP-2 heparin binding domain-containing peptide sequence
KRKIGVEEPHR

SEQ ID NO: 7014 - protein, 11 aa, Artificial
  IGFBP-2 heparin binding domain-containing peptide sequence
RRKIGVEEPHR

SEQ ID NO: 7015 - protein, 11 aa, Artificial
  IGFBP-2 heparin binding domain-containing peptide sequence
HRKIGVEEPHR

SEQ ID NO: 7016 - protein, 11 aa, Artificial
  IGFBP-2 heparin binding domain-containing peptide sequence
KHRIGVEEPHR

SEQ ID NO: 7017 - protein, 11 aa, Artificial
  IGFBP-2 heparin binding domain-containing peptide sequence
RHRIGVEEPHR

SEQ ID NO: 7018 - protein, 11 aa, Artificial
  IGFBP-2 heparin binding domain-containing peptide sequence
HHRIGVEEPHR

SEQ ID NO: 7019 - protein, 11 aa, Artificial
  IGFBP-2 heparin binding domain-containing peptide sequence
KKRIGVEEPHR

SEQ ID NO: 7020 - protein, 11 aa, Artificial
  IGFBP-2 heparin binding domain-containing peptide sequence
RKRIGVEEPHR

SEQ ID NO: 7021 - protein, 11 aa, Artificial
  IGFBP-2 heparin binding domain-containing peptide sequence
HKRIGVEEPHR

SEQ ID NO: 7022 - protein, 11 aa, Artificial
  IGFBP-2 heparin binding domain-containing peptide sequence
KRRIGVEEPHR

SEQ ID NO: 7023 - protein, 11 aa, Artificial
  IGFBP-2 heparin binding domain-containing peptide sequence
RRRIGVEEPHR

SEQ ID NO: 7024 - protein, 11 aa, Artificial
  IGFBP-2 heparin binding domain-containing peptide sequence
HRRIGVEEPHR

SEQ ID NO: 7025 - protein, 11 aa, Artificial
  IGFBP-2 heparin binding domain-containing peptide sequence
KHHVGVEEPHR

SEQ ID NO: 7026 - protein, 11 aa, Artificial
  IGFBP-2 heparin binding domain-containing peptide sequence
RHHVGVEEPHR

SEQ ID NO: 7027 - protein, 11 aa, Artificial
  IGFBP-2 heparin binding domain-containing peptide sequence
HHHVGVEEPHR

SEQ ID NO: 7028 - protein, 11 aa, Artificial
  IGFBP-2 heparin binding domain-containing peptide sequence
KKHVGVEEPHR

SEQ ID NO: 7029 - protein, 11 aa, Artificial
  IGFBP-2 heparin binding domain-containing peptide sequence
RKHVGVEEPHR

SEQ ID NO: 7030 - protein, 11 aa, Artificial
  IGFBP-2 heparin binding domain-containing peptide sequence
HKHVGVEEPHR

SEQ ID NO: 7031 - protein, 11 aa, Artificial
  IGFBP-2 heparin binding domain-containing peptide sequence
KRHVGVEEPHR

SEQ ID NO: 7032 - protein, 11 aa, Artificial
  IGFBP-2 heparin binding domain-containing peptide sequence
RRHVGVEEPHR

SEQ ID NO: 7033 - protein, 11 aa, Artificial
  IGFBP-2 heparin binding domain-containing peptide sequence
HRHVGVEEPHR

SEQ ID NO: 7034 - protein, 11 aa, Artificial
  IGFBP-2 heparin binding domain-containing peptide sequence
KHKVGVEEPHR

SEQ ID NO: 7035 - protein, 11 aa, Artificial
  IGFBP-2 heparin binding domain-containing peptide sequence
RHKVGVEEPHR

SEQ ID NO: 7036 - protein, 11 aa, Artificial
  IGFBP-2 heparin binding domain-containing peptide sequence
HHKVGVEEPHR

SEQ ID NO: 7037 - protein, 11 aa, Artificial
  IGFBP-2 heparin binding domain-containing peptide sequence
KKKVGVEEPHR

SEQ ID NO: 7038 - protein, 11 aa, Artificial
  IGFBP-2 heparin binding domain-containing peptide sequence
RKKVGVEEPHR

SEQ ID NO: 7039 - protein, 11 aa, Artificial
  IGFBP-2 heparin binding domain-containing peptide sequence
HKKVGVEEPHR

SEQ ID NO: 7040 - protein, 11 aa, Artificial
  IGFBP-2 heparin binding domain-containing peptide sequence
KRKVGVEEPHR

SEQ ID NO: 7041 - protein, 11 aa, Artificial
  IGFBP-2 heparin binding domain-containing peptide sequence
RRKVGVEEPHR

SEQ ID NO: 7042 - protein, 11 aa, Artificial
  IGFBP-2 heparin binding domain-containing peptide sequence
HRKVGVEEPHR

SEQ ID NO: 7043 - protein, 11 aa, Artificial
  IGFBP-2 heparin binding domain-containing peptide sequence
KHRVGVEEPHR

SEQ ID NO: 7044 - protein, 11 aa, Artificial
  IGFBP-2 heparin binding domain-containing peptide sequence
RHRVGVEEPHR

SEQ ID NO: 7045 - protein, 11 aa, Artificial
  IGFBP-2 heparin binding domain-containing peptide sequence
HHRVGVEEPHR

SEQ ID NO: 7046 - protein, 11 aa, Artificial
  IGFBP-2 heparin binding domain-containing peptide sequence
KKRVGVEEPHR

SEQ ID NO: 7047 - protein, 11 aa, Artificial
  IGFBP-2 heparin binding domain-containing peptide sequence
RKRVGVEEPHR

SEQ ID NO: 7048 - protein, 11 aa, Artificial
  IGFBP-2 heparin binding domain-containing peptide sequence
HKRVGVEEPHR

SEQ ID NO: 7049 - protein, 11 aa, Artificial
  IGFBP-2 heparin binding domain-containing peptide sequence
KRRVGVEEPHR

SEQ ID NO: 7050 - protein, 11 aa, Artificial
  IGFBP-2 heparin binding domain-containing peptide sequence
RRRVGVEEPHR

SEQ ID NO: 7051 - protein, 11 aa, Artificial
  IGFBP-2 heparin binding domain-containing peptide sequence
HRRVGVEEPHR

SEQ ID NO: 7052 - protein, 11 aa, Artificial
  IGFBP-2 heparin binding domain-containing peptide sequence
KHHLGLNEPHR

SEQ ID NO: 7053 - protein, 11 aa, Artificial
  IGFBP-2 heparin binding domain-containing peptide sequence
RHHLGLNEPHR

SEQ ID NO: 7054 - protein, 11 aa, Artificial
  IGFBP-2 heparin binding domain-containing peptide sequence
HHHLGLNEPHR

SEQ ID NO: 7055 - protein, 11 aa, Artificial
  IGFBP-2 heparin binding domain-containing peptide sequence
KKHLGLNEPHR

SEQ ID NO: 7056 - protein, 11 aa, Artificial
  IGFBP-2 heparin binding domain-containing peptide sequence
RKHLGLNEPHR

SEQ ID NO: 7057 - protein, 11 aa, Artificial
  IGFBP-2 heparin binding domain-containing peptide sequence
HKHLGLNEPHR

SEQ ID NO: 7058 - protein, 11 aa, Artificial
  IGFBP-2 heparin binding domain-containing peptide sequence
KRHLGLNEPHR

SEQ ID NO: 7059 - protein, 11 aa, Artificial
  IGFBP-2 heparin binding domain-containing peptide sequence
RRHLGLNEPHR

SEQ ID NO: 7060 - protein, 11 aa, Artificial
  IGFBP-2 heparin binding domain-containing peptide sequence
HRHLGLNEPHR

SEQ ID NO: 7061 - protein, 11 aa, Artificial
  IGFBP-2 heparin binding domain-containing peptide sequence
KHKLGLNEPHR

SEQ ID NO: 7062 - protein, 11 aa, Artificial
  IGFBP-2 heparin binding domain-containing peptide sequence
RHKLGLNEPHR

SEQ ID NO: 7063 - protein, 11 aa, Artificial
  IGFBP-2 heparin binding domain-containing peptide sequence
HHKLGLNEPHR

SEQ ID NO: 7064 - protein, 11 aa, Artificial
  IGFBP-2 heparin binding domain-containing peptide sequence
KKKLGLNEPHR

SEQ ID NO: 7065 - protein, 11 aa, Artificial
  IGFBP-2 heparin binding domain-containing peptide sequence
RKKLGLNEPHR

SEQ ID NO: 7066 - protein, 11 aa, Artificial
  IGFBP-2 heparin binding domain-containing peptide sequence
HKKLGLNEPHR

SEQ ID NO: 7067 - protein, 11 aa, Artificial
  IGFBP-2 heparin binding domain-containing peptide sequence
KRKLGLNEPHR

SEQ ID NO: 7068 - protein, 11 aa, Artificial
  IGFBP-2 heparin binding domain-containing peptide sequence
RRKLGLNEPHR

SEQ ID NO: 7069 - protein, 11 aa, Artificial
  IGFBP-2 heparin binding domain-containing peptide sequence
HRKLGLNEPHR

SEQ ID NO: 7070 - protein, 11 aa, Artificial
  IGFBP-2 heparin binding domain-containing peptide sequence
KHRLGLNEPHR

SEQ ID NO: 7071 - protein, 11 aa, Artificial
  IGFBP-2 heparin binding domain-containing peptide sequence
RHRLGLNEPHR

SEQ ID NO: 7072 - protein, 11 aa, Artificial
  IGFBP-2 heparin binding domain-containing peptide sequence
HHRLGLNEPHR

SEQ ID NO: 7073 - protein, 11 aa, Artificial
  IGFBP-2 heparin binding domain-containing peptide sequence
KKRLGLNEPHR

SEQ ID NO: 7074 - protein, 11 aa, Artificial
  IGFBP-2 heparin binding domain-containing peptide sequence
RKRLGLNEPHR

SEQ ID NO: 7075 - protein, 11 aa, Artificial
  IGFBP-2 heparin binding domain-containing peptide sequence
HKRLGLNEPHR

SEQ ID NO: 7076 - protein, 11 aa, Artificial
  IGFBP-2 heparin binding domain-containing peptide sequence
KRRLGLNEPHR

SEQ ID NO: 7077 - protein, 11 aa, Artificial
  IGFBP-2 heparin binding domain-containing peptide sequence
RRRLGLNEPHR

SEQ ID NO: 7078 - protein, 11 aa, Artificial
  IGFBP-2 heparin binding domain-containing peptide sequence
HRRLGLNEPHR

SEQ ID NO: 7079 - protein, 10 aa, Artificial
  IGFBP-2 heparin binding domain-containing peptide sequence
KHHIGLNPHR

SEQ ID NO: 7080 - protein, 11 aa, Artificial
  IGFBP-2 heparin binding domain-containing peptide sequence
RHHIGLNEPHR

SEQ ID NO: 7081 - protein, 11 aa, Artificial
  IGFBP-2 heparin binding domain-containing peptide sequence
HHHIGLNEPHR

SEQ ID NO: 7082 - protein, 11 aa, Artificial
  IGFBP-2 heparin binding domain-containing peptide sequence
KKHIGLNEPHR

SEQ ID NO: 7083 - protein, 11 aa, Artificial
  IGFBP-2 heparin binding domain-containing peptide sequence
RKHIGLNEPHR

SEQ ID NO: 7084 - protein, 11 aa, Artificial
  IGFBP-2 heparin binding domain-containing peptide sequence
HKHIGLNEPHR

SEQ ID NO: 7085 - protein, 11 aa, Artificial
  IGFBP-2 heparin binding domain-containing peptide sequence
KRHIGLNEPHR

SEQ ID NO: 7086 - protein, 11 aa, Artificial
  IGFBP-2 heparin binding domain-containing peptide sequence
RRHIGLNEPHR

SEQ ID NO: 7087 - protein, 11 aa, Artificial
  IGFBP-2 heparin binding domain-containing peptide sequence
HRHIGLNEPHR

SEQ ID NO: 7088 - protein, 11 aa, Artificial
  IGFBP-2 heparin binding domain-containing peptide sequence
KHKIGLNEPHR

SEQ ID NO: 7089 - protein, 11 aa, Artificial
  IGFBP-2 heparin binding domain-containing peptide sequence
RHKIGLNEPHR

SEQ ID NO: 7090 - protein, 11 aa, Artificial
  IGFBP-2 heparin binding domain-containing peptide sequence
HHKIGLNEPHR

SEQ ID NO: 7091 - protein, 11 aa, Artificial
  IGFBP-2 heparin binding domain-containing peptide sequence
KKKIGLNEPHR

SEQ ID NO: 7092 - protein, 11 aa, Artificial
  IGFBP-2 heparin binding domain-containing peptide sequence
RKKIGLNEPHR

SEQ ID NO: 7093 - protein, 11 aa, Artificial
  IGFBP-2 heparin binding domain-containing peptide sequence
HKKIGLNEPHR

SEQ ID NO: 7094 - protein, 11 aa, Artificial
  IGFBP-2 heparin binding domain-containing peptide sequence
KRKIGLNEPHR

SEQ ID NO: 7095 - protein, 11 aa, Artificial
  IGFBP-2 heparin binding domain-containing peptide sequence
RRKIGLNEPHR

SEQ ID NO: 7096 - protein, 11 aa, Artificial
  IGFBP-2 heparin binding domain-containing peptide sequence
HRKIGLNEPHR

SEQ ID NO: 7097 - protein, 11 aa, Artificial
  IGFBP-2 heparin binding domain-containing peptide sequence
KHRIGLNEPHR

SEQ ID NO: 7098 - protein, 11 aa, Artificial
  IGFBP-2 heparin binding domain-containing peptide sequence
RHRIGLNEPHR

SEQ ID NO: 7099 - protein, 11 aa, Artificial
  IGFBP-2 heparin binding domain-containing peptide sequence
HHRIGLNEPHR

SEQ ID NO: 7100 - protein, 11 aa, Artificial
  IGFBP-2 heparin binding domain-containing peptide sequence
KKRIGLNEPHR

SEQ ID NO: 7101 - protein, 11 aa, Artificial
  IGFBP-2 heparin binding domain-containing peptide sequence
RKRIGLNEPHR

SEQ ID NO: 7102 - protein, 11 aa, Artificial
  IGFBP-2 heparin binding domain-containing peptide sequence
HKRIGLNEPHR

SEQ ID NO: 7103 - protein, 11 aa, Artificial
  IGFBP-2 heparin binding domain-containing peptide sequence
KRRIGLNEPHR

SEQ ID NO: 7104 - protein, 11 aa, Artificial
  IGFBP-2 heparin binding domain-containing peptide sequence
RRRIGLNEPHR

SEQ ID NO: 7105 - protein, 11 aa, Artificial
  IGFBP-2 heparin binding domain-containing peptide sequence
HRRIGLNEPHR

SEQ ID NO: 7106 - protein, 11 aa, Artificial
  IGFBP-2 heparin binding domain-containing peptide sequence
KHHVGLNEPHR

SEQ ID NO: 7107 - protein, 11 aa, Artificial
  IGFBP-2 heparin binding domain-containing peptide sequence
RHHVGLNEPHR

SEQ ID NO: 7108 - protein, 11 aa, Artificial
  IGFBP-2 heparin binding domain-containing peptide sequence
HHHVGLNEPHR

SEQ ID NO: 7109 - protein, 11 aa, Artificial
  IGFBP-2 heparin binding domain-containing peptide sequence
KKHVGLNEPHR

SEQ ID NO: 7110 - protein, 11 aa, Artificial
  IGFBP-2 heparin binding domain-containing peptide sequence
RKHVGLNEPHR

SEQ ID NO: 7111 - protein, 11 aa, Artificial
  IGFBP-2 heparin binding domain-containing peptide sequence
HKHVGLNEPHR

SEQ ID NO: 7112 - protein, 11 aa, Artificial
  IGFBP-2 heparin binding domain-containing peptide sequence
KRHVGLNEPHR

SEQ ID NO: 7113 - protein, 11 aa, Artificial
  IGFBP-2 heparin binding domain-containing peptide sequence
RRHVGLNEPHR

SEQ ID NO: 7114 - protein, 11 aa, Artificial
  IGFBP-2 heparin binding domain-containing peptide sequence
HRHVGLNEPHR

SEQ ID NO: 7115 - protein, 11 aa, Artificial
  IGFBP-2 heparin binding domain-containing peptide sequence
KHKVGLNEPHR

SEQ ID NO: 7116 - protein, 11 aa, Artificial
  IGFBP-2 heparin binding domain-containing peptide sequence
RHKVGLNEPHR

SEQ ID NO: 7117 - protein, 11 aa, Artificial
  IGFBP-2 heparin binding domain-containing peptide sequence
HHKVGLNEPHR

SEQ ID NO: 7118 - protein, 11 aa, Artificial
  IGFBP-2 heparin binding domain-containing peptide sequence
KKKVGLNEPHR

SEQ ID NO: 7119 - protein, 11 aa, Artificial
  IGFBP-2 heparin binding domain-containing peptide sequence
RKKVGLNEPHR

SEQ ID NO: 7120 - protein, 11 aa, Artificial
  IGFBP-2 heparin binding domain-containing peptide sequence
HKKVGLNEPHR

SEQ ID NO: 7121 - protein, 11 aa, Artificial
  IGFBP-2 heparin binding domain-containing peptide sequence
KRKVGLNEPHR

SEQ ID NO: 7122 - protein, 11 aa, Artificial
  IGFBP-2 heparin binding domain-containing peptide sequence
RRKVGLNEPHR

SEQ ID NO: 7123 - protein, 11 aa, Artificial
  IGFBP-2 heparin binding domain-containing peptide sequence
HRKVGLNEPHR

SEQ ID NO: 7124 - protein, 11 aa, Artificial
  IGFBP-2 heparin binding domain-containing peptide sequence
KHRVGLNEPHR

SEQ ID NO: 7125 - protein, 11 aa, Artificial
  IGFBP-2 heparin binding domain-containing peptide sequence
RHRVGLNEPHR

SEQ ID NO: 7126 - protein, 11 aa, Artificial
  IGFBP-2 heparin binding domain-containing peptide sequence
HHRVGLNEPHR

SEQ ID NO: 7127 - protein, 11 aa, Artificial
  IGFBP-2 heparin binding domain-containing peptide sequence
KKRVGLNEPHR

SEQ ID NO: 7128 - protein, 11 aa, Artificial
  IGFBP-2 heparin binding domain-containing peptide sequence
RKRVGLNEPHR

SEQ ID NO: 7129 - protein, 11 aa, Artificial
  IGFBP-2 heparin binding domain-containing peptide sequence
HKRVGLNEPHR

SEQ ID NO: 7130 - protein, 11 aa, Artificial
  IGFBP-2 heparin binding domain-containing peptide sequence
KRRVGLNEPHR

SEQ ID NO: 7131 - protein, 11 aa, Artificial
  IGFBP-2 heparin binding domain-containing peptide sequence
RRRVGLNEPHR

SEQ ID NO: 7132 - protein, 11 aa, Artificial
  IGFBP-2 heparin binding domain-containing peptide sequence
HRRVGLNEPHR

SEQ ID NO: 7133 - protein, 11 aa, Artificial
  IGFBP-2 heparin binding domain-containing peptide sequence
KHHLGINEPHR

SEQ ID NO: 7134 - protein, 11 aa, Artificial
  IGFBP-2 heparin binding domain-containing peptide sequence
RHHLGINEPHR

SEQ ID NO: 7135 - protein, 11 aa, Artificial
  IGFBP-2 heparin binding domain-containing peptide sequence
HHHLGINEPHR

SEQ ID NO: 7136 - protein, 11 aa, Artificial
  IGFBP-2 heparin binding domain-containing peptide sequence
KKHLGINEPHR

SEQ ID NO: 7137 - protein, 11 aa, Artificial
  IGFBP-2 heparin binding domain-containing peptide sequence
RKHLGINEPHR

SEQ ID NO: 7138 - protein, 11 aa, Artificial
  IGFBP-2 heparin binding domain-containing peptide sequence
HKHLGINEPHR

SEQ ID NO: 7139 - protein, 11 aa, Artificial
  IGFBP-2 heparin binding domain-containing peptide sequence
KRHLGINEPHR

SEQ ID NO: 7140 - protein, 11 aa, Artificial
  IGFBP-2 heparin binding domain-containing peptide sequence
RRHLGINEPHR

SEQ ID NO: 7141 - protein, 11 aa, Artificial
  IGFBP-2 heparin binding domain-containing peptide sequence
HRHLGINEPHR

SEQ ID NO: 7142 - protein, 11 aa, Artificial
  IGFBP-2 heparin binding domain-containing peptide sequence
KHKLGINEPHR

SEQ ID NO: 7143 - protein, 11 aa, Artificial
  IGFBP-2 heparin binding domain-containing peptide sequence
RHKLGINEPHR

SEQ ID NO: 7144 - protein, 11 aa, Artificial
  IGFBP-2 heparin binding domain-containing peptide sequence
HHKLGINEPHR

SEQ ID NO: 7145 - protein, 11 aa, Artificial
  IGFBP-2 heparin binding domain-containing peptide sequence
KKKLGINEPHR

SEQ ID NO: 7146 - protein, 11 aa, Artificial
  IGFBP-2 heparin binding domain-containing peptide sequence
RKKLGINEPHR

SEQ ID NO: 7147 - protein, 11 aa, Artificial
  IGFBP-2 heparin binding domain-containing peptide sequence
HKKLGINEPHR

SEQ ID NO: 7148 - protein, 11 aa, Artificial
  IGFBP-2 heparin binding domain-containing peptide sequence
KRKLGINEPHR

SEQ ID NO: 7149 - protein, 11 aa, Artificial
  IGFBP-2 heparin binding domain-containing peptide sequence
RRKLGINEPHR

SEQ ID NO: 7150 - protein, 11 aa, Artificial
  IGFBP-2 heparin binding domain-containing peptide sequence
HRKLGINEPHR

SEQ ID NO: 7151 - protein, 11 aa, Artificial
  IGFBP-2 heparin binding domain-containing peptide sequence
KHRLGINEPHR

SEQ ID NO: 7152 - protein, 11 aa, Artificial
  IGFBP-2 heparin binding domain-containing peptide sequence
RHRLGINEPHR

SEQ ID NO: 7153 - protein, 11 aa, Artificial
  IGFBP-2 heparin binding domain-containing peptide sequence
HHRLGINEPHR

SEQ ID NO: 7154 - protein, 11 aa, Artificial
  IGFBP-2 heparin binding domain-containing peptide sequence
KKRLGINEPHR

SEQ ID NO: 7155 - protein, 11 aa, Artificial
  IGFBP-2 heparin binding domain-containing peptide sequence
RKRLGINEPHR

SEQ ID NO: 7156 - protein, 11 aa, Artificial
  IGFBP-2 heparin binding domain-containing peptide sequence
HKRLGINEPHR

SEQ ID NO: 7157 - protein, 11 aa, Artificial
  IGFBP-2 heparin binding domain-containing peptide sequence
KRRLGINEPHR

SEQ ID NO: 7158 - protein, 11 aa, Artificial
  IGFBP-2 heparin binding domain-containing peptide sequence
RRRLGINEPHR

SEQ ID NO: 7159 - protein, 11 aa, Artificial
  IGFBP-2 heparin binding domain-containing peptide sequence
HRRLGINEPHR

SEQ ID NO: 7160 - protein, 11 aa, Artificial
  IGFBP-2 heparin binding domain-containing peptide sequence
KHHIGIENPHR

SEQ ID NO: 7161 - protein, 11 aa, Artificial
  IGFBP-2 heparin binding domain-containing peptide sequence
RHHIGINEPHR

SEQ ID NO: 7162 - protein, 11 aa, Artificial
  IGFBP-2 heparin binding domain-containing peptide sequence
HHHIGINEPHR

SEQ ID NO: 7163 - protein, 11 aa, Artificial
  IGFBP-2 heparin binding domain-containing peptide sequence
KKHIGINEPHR

SEQ ID NO: 7164 - protein, 11 aa, Artificial
  IGFBP-2 heparin binding domain-containing peptide sequence
RKHIGINEPHR

SEQ ID NO: 7165 - protein, 11 aa, Artificial
  IGFBP-2 heparin binding domain-containing peptide sequence
HKHIGINEPHR

SEQ ID NO: 7166 - protein, 11 aa, Artificial
  IGFBP-2 heparin binding domain-containing peptide sequence
KRHIGINEPHR

SEQ ID NO: 7167 - protein, 11 aa, Artificial
  IGFBP-2 heparin binding domain-containing peptide sequence
RRHIGINEPHR

SEQ ID NO: 7168 - protein, 11 aa, Artificial
  IGFBP-2 heparin binding domain-containing peptide sequence
HRHIGINEPHR

SEQ ID NO: 7169 - protein, 11 aa, Artificial
  IGFBP-2 heparin binding domain-containing peptide sequence
KHKIGINEPHR

SEQ ID NO: 7170 - protein, 11 aa, Artificial
  IGFBP-2 heparin binding domain-containing peptide sequence
RHKIGINEPHR

SEQ ID NO: 7171 - protein, 11 aa, Artificial
  IGFBP-2 heparin binding domain-containing peptide sequence
HHKIGINEPHR

SEQ ID NO: 7172 - protein, 11 aa, Artificial
  IGFBP-2 heparin binding domain-containing peptide sequence
KKKIGINEPHR

SEQ ID NO: 7173 - protein, 11 aa, Artificial
  IGFBP-2 heparin binding domain-containing peptide sequence
RKKIGINEPHR

SEQ ID NO: 7174 - protein, 11 aa, Artificial
  IGFBP-2 heparin binding domain-containing peptide sequence
HKKIGINEPHR

SEQ ID NO: 7175 - protein, 11 aa, Artificial
  IGFBP-2 heparin binding domain-containing peptide sequence
KRKIGINEPHR

SEQ ID NO: 7176 - protein, 11 aa, Artificial
  IGFBP-2 heparin binding domain-containing peptide sequence
RRKIGINEPHR

SEQ ID NO: 7177 - protein, 11 aa, Artificial
  IGFBP-2 heparin binding domain-containing peptide sequence
HRKIGINEPHR

SEQ ID NO: 7178 - protein, 11 aa, Artificial
  IGFBP-2 heparin binding domain-containing peptide sequence
KHRIGINEPHR

SEQ ID NO: 7179 - protein, 11 aa, Artificial
  IGFBP-2 heparin binding domain-containing peptide sequence
RHRIGINEPHR

SEQ ID NO: 7180 - protein, 11 aa, Artificial
  IGFBP-2 heparin binding domain-containing peptide sequence
HHRIGINEPHR

SEQ ID NO: 7181 - protein, 11 aa, Artificial
  IGFBP-2 heparin binding domain-containing peptide sequence
KKRIGINEPHR

SEQ ID NO: 7182 - protein, 11 aa, Artificial
  IGFBP-2 heparin binding domain-containing peptide sequence
RKRIGINEPHR

SEQ ID NO: 7183 - protein, 11 aa, Artificial
  IGFBP-2 heparin binding domain-containing peptide sequence
HKRIGINEPHR

SEQ ID NO: 7184 - protein, 11 aa, Artificial
  IGFBP-2 heparin binding domain-containing peptide sequence
KRRIGINEPHR

SEQ ID NO: 7185 - protein, 11 aa, Artificial
  IGFBP-2 heparin binding domain-containing peptide sequence
RRRIGINEPHR

SEQ ID NO: 7186 - protein, 11 aa, Artificial
  IGFBP-2 heparin binding domain-containing peptide sequence
HRRIGINEPHR

SEQ ID NO: 7187 - protein, 11 aa, Artificial
  IGFBP-2 heparin binding domain-containing peptide sequence
KHHVGINEPHR

SEQ ID NO: 7188 - protein, 11 aa, Artificial
  IGFBP-2 heparin binding domain-containing peptide sequence
RHHVGINEPHR

SEQ ID NO: 7189 - protein, 11 aa, Artificial
  IGFBP-2 heparin binding domain-containing peptide sequence
HHHVGINEPHR

SEQ ID NO: 7190 - protein, 11 aa, Artificial
  IGFBP-2 heparin binding domain-containing peptide sequence
KKHVGINEPHR

SEQ ID NO: 7191 - protein, 11 aa, Artificial
  IGFBP-2 heparin binding domain-containing peptide sequence
RKHVGINEPHR

SEQ ID NO: 7192 - protein, 11 aa, Artificial
  IGFBP-2 heparin binding domain-containing peptide sequence
HKHVGINEPHR

SEQ ID NO: 7193 - protein, 11 aa, Artificial
  IGFBP-2 heparin binding domain-containing peptide sequence
KRHVGINEPHR

SEQ ID NO: 7194 - protein, 11 aa, Artificial
  IGFBP-2 heparin binding domain-containing peptide sequence
RRHVGINEPHR

SEQ ID NO: 7195 - protein, 11 aa, Artificial
  IGFBP-2 heparin binding domain-containing peptide sequence
HRHVGINEPHR

SEQ ID NO: 7196 - protein, 11 aa, Artificial
  IGFBP-2 heparin binding domain-containing peptide sequence
KHKVGINEPHR

SEQ ID NO: 7197 - protein, 11 aa, Artificial
  IGFBP-2 heparin binding domain-containing peptide sequence
RHKVGINEPHR

SEQ ID NO: 7198 - protein, 11 aa, Artificial
  IGFBP-2 heparin binding domain-containing peptide sequence
HHKVGINEPHR

SEQ ID NO: 7199 - protein, 11 aa, Artificial
  IGFBP-2 heparin binding domain-containing peptide sequence
KKKVGINEPHR

SEQ ID NO: 7200 - protein, 11 aa, Artificial
  IGFBP-2 heparin binding domain-containing peptide sequence
RKKVGINEPHR

SEQ ID NO: 7201 - protein, 11 aa, Artificial
  IGFBP-2 heparin binding domain-containing peptide sequence
HKKVGINEPHR

SEQ ID NO: 7202 - protein, 11 aa, Artificial
  IGFBP-2 heparin binding domain-containing peptide sequence
KRKVGINEPHR

SEQ ID NO: 7203 - protein, 11 aa, Artificial
  IGFBP-2 heparin binding domain-containing peptide sequence
RRKVGINEPHR

SEQ ID NO: 7204 - protein, 11 aa, Artificial
  IGFBP-2 heparin binding domain-containing peptide sequence
HRKVGINEPHR

SEQ ID NO: 7205 - protein, 11 aa, Artificial
  IGFBP-2 heparin binding domain-containing peptide sequence
KHRVGINEPHR

SEQ ID NO: 7206 - protein, 11 aa, Artificial
  IGFBP-2 heparin binding domain-containing peptide sequence
RHRVGINEPHR

SEQ ID NO: 7207 - protein, 11 aa, Artificial
  IGFBP-2 heparin binding domain-containing peptide sequence
HHRVGINEPHR

SEQ ID NO: 7208 - protein, 11 aa, Artificial
  IGFBP-2 heparin binding domain-containing peptide sequence
KKRVGINEPHR

SEQ ID NO: 7209 - protein, 11 aa, Artificial
  IGFBP-2 heparin binding domain-containing peptide sequence
RKRVGINEPHR

SEQ ID NO: 7210 - protein, 11 aa, Artificial
  IGFBP-2 heparin binding domain-containing peptide sequence
HKRVGINEPHR

SEQ ID NO: 7211 - protein, 11 aa, Artificial
  IGFBP-2 heparin binding domain-containing peptide sequence
KRRVGINEPHR

SEQ ID NO: 7212 - protein, 11 aa, Artificial
  IGFBP-2 heparin binding domain-containing peptide sequence
RRRVGINEPHR

SEQ ID NO: 7213 - protein, 11 aa, Artificial
  IGFBP-2 heparin binding domain-containing peptide sequence
HRRVGINEPHR

SEQ ID NO: 7214 - protein, 11 aa, Artificial
  IGFBP-2 heparin binding domain-containing peptide sequence
KHHLGVNEPHR

SEQ ID NO: 7215 - protein, 11 aa, Artificial
  IGFBP-2 heparin binding domain-containing peptide sequence
RHHLGVNEPHR

SEQ ID NO: 7216 - protein, 11 aa, Artificial
  IGFBP-2 heparin binding domain-containing peptide sequence
HHHLGVNEPHR

SEQ ID NO: 7217 - protein, 11 aa, Artificial
  IGFBP-2 heparin binding domain-containing peptide sequence
KKHLGVNEPHR

SEQ ID NO: 7218 - protein, 11 aa, Artificial
  IGFBP-2 heparin binding domain-containing peptide sequence
RKHLGVNEPHR

SEQ ID NO: 7219 - protein, 11 aa, Artificial
  IGFBP-2 heparin binding domain-containing peptide sequence
HKHLGVNEPHR

SEQ ID NO: 7220 - protein, 11 aa, Artificial
  IGFBP-2 heparin binding domain-containing peptide sequence
KRHLGVNEPHR

SEQ ID NO: 7221 - protein, 11 aa, Artificial
  IGFBP-2 heparin binding domain-containing peptide sequence
RRHLGVNEPHR

SEQ ID NO: 7222 - protein, 11 aa, Artificial
  IGFBP-2 heparin binding domain-containing peptide sequence
HRHLGVNEPHR

SEQ ID NO: 7223 - protein, 11 aa, Artificial
  IGFBP-2 heparin binding domain-containing peptide sequence
KHKLGVNEPHR

SEQ ID NO: 7224 - protein, 11 aa, Artificial
  IGFBP-2 heparin binding domain-containing peptide sequence
RHKLGVNEPHR

SEQ ID NO: 7225 - protein, 11 aa, Artificial
  IGFBP-2 heparin binding domain-containing peptide sequence
HHKLGVNEPHR

SEQ ID NO: 7226 - protein, 11 aa, Artificial
  IGFBP-2 heparin binding domain-containing peptide sequence
KKKLGVNEPHR

SEQ ID NO: 7227 - protein, 11 aa, Artificial
  IGFBP-2 heparin binding domain-containing peptide sequence
RKKLGVNEPHR

SEQ ID NO: 7228 - protein, 11 aa, Artificial
  IGFBP-2 heparin binding domain-containing peptide sequence
HKKLGVNEPHR

SEQ ID NO: 7229 - protein, 11 aa, Artificial
  IGFBP-2 heparin binding domain-containing peptide sequence
KRKLGVNEPHR

SEQ ID NO: 7230 - protein, 11 aa, Artificial
  IGFBP-2 heparin binding domain-containing peptide sequence
RRKLGVNEPHR

SEQ ID NO: 7231 - protein, 11 aa, Artificial
  IGFBP-2 heparin binding domain-containing peptide sequence
HRKLGVNEPHR

SEQ ID NO: 7232 - protein, 11 aa, Artificial
  IGFBP-2 heparin binding domain-containing peptide sequence
KHRLGVNEPHR

SEQ ID NO: 7233 - protein, 11 aa, Artificial
  IGFBP-2 heparin binding domain-containing peptide sequence
RHRLGVNEPHR

SEQ ID NO: 7234 - protein, 11 aa, Artificial
  IGFBP-2 heparin binding domain-containing peptide sequence
HHRLGVNEPHR

SEQ ID NO: 7235 - protein, 11 aa, Artificial
  IGFBP-2 heparin binding domain-containing peptide sequence
KKRLGVNEPHR

SEQ ID NO: 7236 - protein, 11 aa, Artificial
  IGFBP-2 heparin binding domain-containing peptide sequence
RKRLGVNEPHR

SEQ ID NO: 7237 - protein, 11 aa, Artificial
  IGFBP-2 heparin binding domain-containing peptide sequence
HKRLGVNEPHR

SEQ ID NO: 7238 - protein, 11 aa, Artificial
  IGFBP-2 heparin binding domain-containing peptide sequence
KRRLGVNEPHR

SEQ ID NO: 7239 - protein, 11 aa, Artificial
  IGFBP-2 heparin binding domain-containing peptide sequence
RRRLGVNEPHR

SEQ ID NO: 7240 - protein, 11 aa, Artificial
  IGFBP-2 heparin binding domain-containing peptide sequence
HRRLGVNEPHR

SEQ ID NO: 7241 - protein, 11 aa, Artificial
  IGFBP-2 heparin binding domain-containing peptide sequence
KHHIGVNEPHR

SEQ ID NO: 7242 - protein, 11 aa, Artificial
  IGFBP-2 heparin binding domain-containing peptide sequence
RHHIGVNEPHR

SEQ ID NO: 7243 - protein, 11 aa, Artificial
  IGFBP-2 heparin binding domain-containing peptide sequence
HHHIGVNEPHR

SEQ ID NO: 7244 - protein, 11 aa, Artificial
  IGFBP-2 heparin binding domain-containing peptide sequence
KKHIGVNEPHR

SEQ ID NO: 7245 - protein, 11 aa, Artificial
  IGFBP-2 heparin binding domain-containing peptide sequence
RKHIGVNEPHR

SEQ ID NO: 7246 - protein, 11 aa, Artificial
  IGFBP-2 heparin binding domain-containing peptide sequence
HKHIGVNEPHR

SEQ ID NO: 7247 - protein, 11 aa, Artificial
  IGFBP-2 heparin binding domain-containing peptide sequence
KRHIGVNEPHR

SEQ ID NO: 7248 - protein, 11 aa, Artificial
  IGFBP-2 heparin binding domain-containing peptide sequence
RRHIGVNEPHR

SEQ ID NO: 7249 - protein, 11 aa, Artificial
  IGFBP-2 heparin binding domain-containing peptide sequence
HRHIGVNEPHR

SEQ ID NO: 7250 - protein, 11 aa, Artificial
  IGFBP-2 heparin binding domain-containing peptide sequence
KHKIGVNEPHR

SEQ ID NO: 7251 - protein, 11 aa, Artificial
  IGFBP-2 heparin binding domain-containing peptide sequence
RHKIGVNEPHR

SEQ ID NO: 7252 - protein, 11 aa, Artificial
  IGFBP-2 heparin binding domain-containing peptide sequence
HHKIGVNEPHR

SEQ ID NO: 7253 - protein, 11 aa, Artificial
  IGFBP-2 heparin binding domain-containing peptide sequence
KKKIGVNEPHR

SEQ ID NO: 7254 - protein, 11 aa, Artificial
  IGFBP-2 heparin binding domain-containing peptide sequence
RKKIGVNEPHR

SEQ ID NO: 7255 - protein, 11 aa, Artificial
  IGFBP-2 heparin binding domain-containing peptide sequence
HKKIGVNEPHR

SEQ ID NO: 7256 - protein, 11 aa, Artificial
  IGFBP-2 heparin binding domain-containing peptide sequence
KRKIGVNEPHR

SEQ ID NO: 7257 - protein, 11 aa, Artificial
  IGFBP-2 heparin binding domain-containing peptide sequence
RRKIGVNEPHR

SEQ ID NO: 7258 - protein, 11 aa, Artificial
  IGFBP-2 heparin binding domain-containing peptide sequence
HRKIGVNEPHR

SEQ ID NO: 7259 - protein, 11 aa, Artificial
  IGFBP-2 heparin binding domain-containing peptide sequence
KHRIGVNEPHR

SEQ ID NO: 7260 - protein, 11 aa, Artificial
  IGFBP-2 heparin binding domain-containing peptide sequence
RHRIGVNEPHR

SEQ ID NO: 7261 - protein, 11 aa, Artificial
  IGFBP-2 heparin binding domain-containing peptide sequence
HHRIGVNEPHR

SEQ ID NO: 7262 - protein, 11 aa, Artificial
  IGFBP-2 heparin binding domain-containing peptide sequence
KKRIGVNEPHR

SEQ ID NO: 7263 - protein, 11 aa, Artificial
  IGFBP-2 heparin binding domain-containing peptide sequence
RKRIGVNEPHR

SEQ ID NO: 7264 - protein, 11 aa, Artificial
  IGFBP-2 heparin binding domain-containing peptide sequence
HKRIGVNEPHR

SEQ ID NO: 7265 - protein, 11 aa, Artificial
  IGFBP-2 heparin binding domain-containing peptide sequence
KRRIGVNEPHR

SEQ ID NO: 7266 - protein, 11 aa, Artificial
  IGFBP-2 heparin binding domain-containing peptide sequence
RRRIGVNEPHR

SEQ ID NO: 7267 - protein, 11 aa, Artificial
  IGFBP-2 heparin binding domain-containing peptide sequence
HRRIGVNEPHR

SEQ ID NO: 7268 - protein, 11 aa, Artificial
  IGFBP-2 heparin binding domain-containing peptide sequence
KHHVGVNEPHR

SEQ ID NO: 7269 - protein, 11 aa, Artificial
  IGFBP-2 heparin binding domain-containing peptide sequence
RHHVGVNEPHR

SEQ ID NO: 7270 - protein, 11 aa, Artificial
  IGFBP-2 heparin binding domain-containing peptide sequence
HHHVGVNEPHR

SEQ ID NO: 7271 - protein, 11 aa, Artificial
  IGFBP-2 heparin binding domain-containing peptide sequence
KKHVGVNEPHR

SEQ ID NO: 7272 - protein, 11 aa, Artificial
  IGFBP-2 heparin binding domain-containing peptide sequence
RKHVGVNEPHR

SEQ ID NO: 7273 - protein, 11 aa, Artificial
  IGFBP-2 heparin binding domain-containing peptide sequence
HKHVGVNEPHR

SEQ ID NO: 7274 - protein, 11 aa, Artificial
  IGFBP-2 heparin binding domain-containing peptide sequence
KRHVGVNEPHR

SEQ ID NO: 7275 - protein, 11 aa, Artificial
  IGFBP-2 heparin binding domain-containing peptide sequence
RRHVGVNEPHR

SEQ ID NO: 7276 - protein, 11 aa, Artificial
  IGFBP-2 heparin binding domain-containing peptide sequence
HRHVGVNEPHR

SEQ ID NO: 7277 - protein, 11 aa, Artificial
  IGFBP-2 heparin binding domain-containing peptide sequence
KHKVGVNEPHR

SEQ ID NO: 7278 - protein, 11 aa, Artificial
  IGFBP-2 heparin binding domain-containing peptide sequence
RHKVGVNEPHR

SEQ ID NO: 7279 - protein, 11 aa, Artificial
  IGFBP-2 heparin binding domain-containing peptide sequence
HHKVGVNEPHR

SEQ ID NO: 7280 - protein, 11 aa, Artificial
  IGFBP-2 heparin binding domain-containing peptide sequence
KKKVGVNEPHR

SEQ ID NO: 7281 - protein, 11 aa, Artificial
  IGFBP-2 heparin binding domain-containing peptide sequence
RKKVGVNEPHR

SEQ ID NO: 7282 - protein, 11 aa, Artificial
  IGFBP-2 heparin binding domain-containing peptide sequence
HKKVGVNEPHR

SEQ ID NO: 7283 - protein, 11 aa, Artificial
  IGFBP-2 heparin binding domain-containing peptide sequence
KRKVGVNEPHR

SEQ ID NO: 7284 - protein, 11 aa, Artificial
  IGFBP-2 heparin binding domain-containing peptide sequence
RRKVGVNEPHR

SEQ ID NO: 7285 - protein, 11 aa, Artificial
  IGFBP-2 heparin binding domain-containing peptide sequence
HRKVGVNEPHR

SEQ ID NO: 7286 - protein, 11 aa, Artificial
  IGFBP-2 heparin binding domain-containing peptide sequence
KHRVGVNEPHR

SEQ ID NO: 7287 - protein, 11 aa, Artificial
  IGFBP-2 heparin binding domain-containing peptide sequence
RHRVGVNEPHR

SEQ ID NO: 7288 - protein, 11 aa, Artificial
  IGFBP-2 heparin binding domain-containing peptide sequence
HHRVGVNEPHR

SEQ ID NO: 7289 - protein, 11 aa, Artificial
  IGFBP-2 heparin binding domain-containing peptide sequence
KKRVGVNEPHR

SEQ ID NO: 7290 - protein, 11 aa, Artificial
  IGFBP-2 heparin binding domain-containing peptide sequence
RKRVGVNEPHR

SEQ ID NO: 7291 - protein, 11 aa, Artificial
  IGFBP-2 heparin binding domain-containing peptide sequence
HKRVGVNEPHR

SEQ ID NO: 7292 - protein, 11 aa, Artificial
  IGFBP-2 heparin binding domain-containing peptide sequence
KRRVGVNEPHR

SEQ ID NO: 7293 - protein, 11 aa, Artificial
  IGFBP-2 heparin binding domain-containing peptide sequence
RRRVGVNEPHR

SEQ ID NO: 7294 - protein, 11 aa, Artificial
  IGFBP-2 heparin binding domain-containing peptide sequence
HRRVGVNEPHR

SEQ ID NO: 7295 - protein, 11 aa, Artificial
  IGFBP-2 heparin binding domain-containing peptide sequence
KHHLGLENPHR

SEQ ID NO: 7296 - protein, 11 aa, Artificial
  IGFBP-2 heparin binding domain-containing peptide sequence
RHHLGLENPHR

SEQ ID NO: 7297 - protein, 11 aa, Artificial
  IGFBP-2 heparin binding domain-containing peptide sequence
HHHLGLENPHR

SEQ ID NO: 7298 - protein, 11 aa, Artificial
  IGFBP-2 heparin binding domain-containing peptide sequence
KKHLGLENPHR

SEQ ID NO: 7299 - protein, 11 aa, Artificial
  IGFBP-2 heparin binding domain-containing peptide sequence
RKHLGLENPHR

SEQ ID NO: 7300 - protein, 11 aa, Artificial
  IGFBP-2 heparin binding domain-containing peptide sequence
HKHLGLENPHR

SEQ ID NO: 7301 - protein, 11 aa, Artificial
  IGFBP-2 heparin binding domain-containing peptide sequence
KRHLGLENPHR

SEQ ID NO: 7302 - protein, 11 aa, Artificial
  IGFBP-2 heparin binding domain-containing peptide sequence
RRHLGLENPHR

SEQ ID NO: 7303 - protein, 11 aa, Artificial
  IGFBP-2 heparin binding domain-containing peptide sequence
HRHLGLENPHR

SEQ ID NO: 7304 - protein, 11 aa, Artificial
  IGFBP-2 heparin binding domain-containing peptide sequence
KHKLGLENPHR

SEQ ID NO: 7305 - protein, 11 aa, Artificial
  IGFBP-2 heparin binding domain-containing peptide sequence
RHKLGLENPHR

SEQ ID NO: 7306 - protein, 11 aa, Artificial
  IGFBP-2 heparin binding domain-containing peptide sequence
HHKLGLENPHR

SEQ ID NO: 7307 - protein, 11 aa, Artificial
  IGFBP-2 heparin binding domain-containing peptide sequence
KKKLGLENPHR

SEQ ID NO: 7308 - protein, 11 aa, Artificial
  IGFBP-2 heparin binding domain-containing peptide sequence
RKKLGLENPHR

SEQ ID NO: 7309 - protein, 11 aa, Artificial
  IGFBP-2 heparin binding domain-containing peptide sequence
HKKLGLENPHR

SEQ ID NO: 7310 - protein, 11 aa, Artificial
  IGFBP-2 heparin binding domain-containing peptide sequence
KRKLGLENPHR

SEQ ID NO: 7311 - protein, 11 aa, Artificial
  IGFBP-2 heparin binding domain-containing peptide sequence
RRKLGLENPHR

SEQ ID NO: 7312 - protein, 11 aa, Artificial
  IGFBP-2 heparin binding domain-containing peptide sequence
HRKLGLENPHR

SEQ ID NO: 7313 - protein, 11 aa, Artificial
  IGFBP-2 heparin binding domain-containing peptide sequence
KHRLGLENPHR

SEQ ID NO: 7314 - protein, 11 aa, Artificial
  IGFBP-2 heparin binding domain-containing peptide sequence
RHRLGLENPHR

SEQ ID NO: 7315 - protein, 11 aa, Artificial
  IGFBP-2 heparin binding domain-containing peptide sequence
HHRLGLENPHR

SEQ ID NO: 7316 - protein, 11 aa, Artificial
  IGFBP-2 heparin binding domain-containing peptide sequence
KKRLGLENPHR

SEQ ID NO: 7317 - protein, 11 aa, Artificial
  IGFBP-2 heparin binding domain-containing peptide sequence
RKRLGLENPHR

SEQ ID NO: 7318 - protein, 11 aa, Artificial
  IGFBP-2 heparin binding domain-containing peptide sequence
HKRLGLENPHR

SEQ ID NO: 7319 - protein, 11 aa, Artificial
  IGFBP-2 heparin binding domain-containing peptide sequence
KRRLGLENPHR

SEQ ID NO: 7320 - protein, 11 aa, Artificial
  IGFBP-2 heparin binding domain-containing peptide sequence
RRRLGLENPHR

SEQ ID NO: 7321 - protein, 11 aa, Artificial
  IGFBP-2 heparin binding domain-containing peptide sequence
HRRLGLENPHR

SEQ ID NO: 7322 - protein, 11 aa, Artificial
  IGFBP-2 heparin binding domain-containing peptide sequence
KHHIGLENPHR

SEQ ID NO: 7323 - protein, 11 aa, Artificial
  IGFBP-2 heparin binding domain-containing peptide sequence
RHHIGLENPHR

SEQ ID NO: 7324 - protein, 11 aa, Artificial
  IGFBP-2 heparin binding domain-containing peptide sequence
HHHIGLENPHR

SEQ ID NO: 7325 - protein, 11 aa, Artificial
  IGFBP-2 heparin binding domain-containing peptide sequence
KKHIGLENPHR

SEQ ID NO: 7326 - protein, 11 aa, Artificial
  IGFBP-2 heparin binding domain-containing peptide sequence
RKHIGLENPHR

SEQ ID NO: 7327 - protein, 11 aa, Artificial
  IGFBP-2 heparin binding domain-containing peptide sequence
HKHIGLENPHR

SEQ ID NO: 7328 - protein, 11 aa, Artificial
  IGFBP-2 heparin binding domain-containing peptide sequence
KRHIGLENPHR

SEQ ID NO: 7329 - protein, 11 aa, Artificial
  IGFBP-2 heparin binding domain-containing peptide sequence
RRHIGLENPHR

SEQ ID NO: 7330 - protein, 11 aa, Artificial
  IGFBP-2 heparin binding domain-containing peptide sequence
HRHIGLENPHR

SEQ ID NO: 7331 - protein, 11 aa, Artificial
  IGFBP-2 heparin binding domain-containing peptide sequence
KHKIGLENPHR

SEQ ID NO: 7332 - protein, 11 aa, Artificial
  IGFBP-2 heparin binding domain-containing peptide sequence
RHKIGLENPHR

SEQ ID NO: 7333 - protein, 11 aa, Artificial
  IGFBP-2 heparin binding domain-containing peptide sequence
HHKIGLENPHR

SEQ ID NO: 7334 - protein, 11 aa, Artificial
  IGFBP-2 heparin binding domain-containing peptide sequence
KKKIGLENPHR

SEQ ID NO: 7335 - protein, 11 aa, Artificial
  IGFBP-2 heparin binding domain-containing peptide sequence
RKKIGLENPHR

SEQ ID NO: 7336 - protein, 11 aa, Artificial
  IGFBP-2 heparin binding domain-containing peptide sequence
HKKIGLENPHR

SEQ ID NO: 7337 - protein, 11 aa, Artificial
  IGFBP-2 heparin binding domain-containing peptide sequence
KRKIGLENPHR

SEQ ID NO: 7338 - protein, 11 aa, Artificial
  IGFBP-2 heparin binding domain-containing peptide sequence
RRKIGLENPHR

SEQ ID NO: 7339 - protein, 11 aa, Artificial
  IGFBP-2 heparin binding domain-containing peptide sequence
HRKIGLENPHR

SEQ ID NO: 7340 - protein, 11 aa, Artificial
  IGFBP-2 heparin binding domain-containing peptide sequence
KHRIGLENPHR

SEQ ID NO: 7341 - protein, 11 aa, Artificial
  IGFBP-2 heparin binding domain-containing peptide sequence
RHRIGLENPHR

SEQ ID NO: 7342 - protein, 11 aa, Artificial
  IGFBP-2 heparin binding domain-containing peptide sequence
HHRIGLENPHR

SEQ ID NO: 7343 - protein, 11 aa, Artificial
  IGFBP-2 heparin binding domain-containing peptide sequence
KKRIGLENPHR

SEQ ID NO: 7344 - protein, 11 aa, Artificial
  IGFBP-2 heparin binding domain-containing peptide sequence
RKRIGLENPHR

SEQ ID NO: 7345 - protein, 11 aa, Artificial
  IGFBP-2 heparin binding domain-containing peptide sequence
HKRIGLENPHR

SEQ ID NO: 7346 - protein, 11 aa, Artificial
  IGFBP-2 heparin binding domain-containing peptide sequence
KRRIGLENPHR

SEQ ID NO: 7347 - protein, 11 aa, Artificial
  IGFBP-2 heparin binding domain-containing peptide sequence
RRRIGLENPHR

SEQ ID NO: 7348 - protein, 11 aa, Artificial
  IGFBP-2 heparin binding domain-containing peptide sequence
HRRIGLENPHR

SEQ ID NO: 7349 - protein, 11 aa, Artificial
  IGFBP-2 heparin binding domain-containing peptide sequence
KHHVGLENPHR

SEQ ID NO: 7350 - protein, 11 aa, Artificial
  IGFBP-2 heparin binding domain-containing peptide sequence
RHHVGLENPHR

SEQ ID NO: 7351 - protein, 11 aa, Artificial
  IGFBP-2 heparin binding domain-containing peptide sequence
HHHVGLENPHR

SEQ ID NO: 7352 - protein, 11 aa, Artificial
  IGFBP-2 heparin binding domain-containing peptide sequence
KKHVGLENPHR

SEQ ID NO: 7353 - protein, 11 aa, Artificial
  IGFBP-2 heparin binding domain-containing peptide sequence
RKHVGLENPHR

SEQ ID NO: 7354 - protein, 11 aa, Artificial
  IGFBP-2 heparin binding domain-containing peptide sequence
HKHVGLENPHR

SEQ ID NO: 7355 - protein, 11 aa, Artificial
  IGFBP-2 heparin binding domain-containing peptide sequence
KRHVGLENPHR

SEQ ID NO: 7356 - protein, 11 aa, Artificial
  IGFBP-2 heparin binding domain-containing peptide sequence
RRHVGLENPHR

SEQ ID NO: 7357 - protein, 11 aa, Artificial
  IGFBP-2 heparin binding domain-containing peptide sequence
HRHVGLENPHR

SEQ ID NO: 7358 - protein, 11 aa, Artificial
  IGFBP-2 heparin binding domain-containing peptide sequence
KHKVGLENPHR

SEQ ID NO: 7359 - protein, 11 aa, Artificial
  IGFBP-2 heparin binding domain-containing peptide sequence
RHKVGLENPHR

SEQ ID NO: 7360 - protein, 11 aa, Artificial
  IGFBP-2 heparin binding domain-containing peptide sequence
HHKVGLENPHR

SEQ ID NO: 7361 - protein, 11 aa, Artificial
  IGFBP-2 heparin binding domain-containing peptide sequence
KKKVGLENPHR

SEQ ID NO: 7362 - protein, 11 aa, Artificial
  IGFBP-2 heparin binding domain-containing peptide sequence
RKKVGLENPHR

SEQ ID NO: 7363 - protein, 11 aa, Artificial
  IGFBP-2 heparin binding domain-containing peptide sequence
HKKVGLENPHR

SEQ ID NO: 7364 - protein, 11 aa, Artificial
  IGFBP-2 heparin binding domain-containing peptide sequence
KRKVGLENPHR

SEQ ID NO: 7365 - protein, 11 aa, Artificial
  IGFBP-2 heparin binding domain-containing peptide sequence
RRKVGLENPHR

SEQ ID NO: 7366 - protein, 11 aa, Artificial
  IGFBP-2 heparin binding domain-containing peptide sequence
HRKVGLENPHR

SEQ ID NO: 7367 - protein, 11 aa, Artificial
  IGFBP-2 heparin binding domain-containing peptide sequence
KHRVGLENPHR

SEQ ID NO: 7368 - protein, 11 aa, Artificial
  IGFBP-2 heparin binding domain-containing peptide sequence
RHRVGLENPHR

SEQ ID NO: 7369 - protein, 11 aa, Artificial
  IGFBP-2 heparin binding domain-containing peptide sequence
HHRVGLENPHR

SEQ ID NO: 7370 - protein, 11 aa, Artificial
  IGFBP-2 heparin binding domain-containing peptide sequence
KKRVGLENPHR

SEQ ID NO: 7371 - protein, 11 aa, Artificial
  IGFBP-2 heparin binding domain-containing peptide sequence
RKRVGLENPHR

SEQ ID NO: 7372 - protein, 11 aa, Artificial
  IGFBP-2 heparin binding domain-containing peptide sequence
HKRVGLENPHR

SEQ ID NO: 7373 - protein, 11 aa, Artificial
  IGFBP-2 heparin binding domain-containing peptide sequence
KRRVGLENPHR

SEQ ID NO: 7374 - protein, 11 aa, Artificial
  IGFBP-2 heparin binding domain-containing peptide sequence
RRRVGLENPHR

SEQ ID NO: 7375 - protein, 11 aa, Artificial
  IGFBP-2 heparin binding domain-containing peptide sequence
HRRVGLENPHR

SEQ ID NO: 7376 - protein, 11 aa, Artificial
  IGFBP-2 heparin binding domain-containing peptide sequence
KHHLGIENPHR

SEQ ID NO: 7377 - protein, 11 aa, Artificial
  IGFBP-2 heparin binding domain-containing peptide sequence
RHHLGIENPHR

SEQ ID NO: 7378 - protein, 11 aa, Artificial
  IGFBP-2 heparin binding domain-containing peptide sequence
HHHLGIENPHR

SEQ ID NO: 7379 - protein, 11 aa, Artificial
  IGFBP-2 heparin binding domain-containing peptide sequence
KKHLGIENPHR

SEQ ID NO: 7380 - protein, 11 aa, Artificial
  IGFBP-2 heparin binding domain-containing peptide sequence
RKHLGIENPHR

SEQ ID NO: 7381 - protein, 11 aa, Artificial
  IGFBP-2 heparin binding domain-containing peptide sequence
HKHLGIENPHR

SEQ ID NO: 7382 - protein, 11 aa, Artificial
  IGFBP-2 heparin binding domain-containing peptide sequence
KRHLGIENPHR

SEQ ID NO: 7383 - protein, 11 aa, Artificial
  IGFBP-2 heparin binding domain-containing peptide sequence
RRHLGIENPHR

SEQ ID NO: 7384 - protein, 11 aa, Artificial
  IGFBP-2 heparin binding domain-containing peptide sequence
HRHLGIENPHR

SEQ ID NO: 7385 - protein, 11 aa, Artificial
  IGFBP-2 heparin binding domain-containing peptide sequence
KHKLGIENPHR

SEQ ID NO: 7386 - protein, 11 aa, Artificial
  IGFBP-2 heparin binding domain-containing peptide sequence
RHKLGIENPHR

SEQ ID NO: 7387 - protein, 11 aa, Artificial
  IGFBP-2 heparin binding domain-containing peptide sequence
HHKLGIENPHR

SEQ ID NO: 7388 - protein, 11 aa, Artificial
  IGFBP-2 heparin binding domain-containing peptide sequence
KKKLGIENPHR

SEQ ID NO: 7389 - protein, 11 aa, Artificial
  IGFBP-2 heparin binding domain-containing peptide sequence
RKKLGIENPHR

SEQ ID NO: 7390 - protein, 11 aa, Artificial
  IGFBP-2 heparin binding domain-containing peptide sequence
HKKLGIENPHR

SEQ ID NO: 7391 - protein, 11 aa, Artificial
  IGFBP-2 heparin binding domain-containing peptide sequence
KRKLGIENPHR

SEQ ID NO: 7392 - protein, 11 aa, Artificial
  IGFBP-2 heparin binding domain-containing peptide sequence
RRKLGIENPHR

SEQ ID NO: 7393 - protein, 11 aa, Artificial
  IGFBP-2 heparin binding domain-containing peptide sequence
HRKLGIENPHR

SEQ ID NO: 7394 - protein, 11 aa, Artificial
  IGFBP-2 heparin binding domain-containing peptide sequence
KHRLGIENPHR

SEQ ID NO: 7395 - protein, 11 aa, Artificial
  IGFBP-2 heparin binding domain-containing peptide sequence
RHRLGIENPHR

SEQ ID NO: 7396 - protein, 11 aa, Artificial
  IGFBP-2 heparin binding domain-containing peptide sequence
HHRLGIENPHR

SEQ ID NO: 7397 - protein, 11 aa, Artificial
  IGFBP-2 heparin binding domain-containing peptide sequence
KKRLGIENPHR

SEQ ID NO: 7398 - protein, 11 aa, Artificial
  IGFBP-2 heparin binding domain-containing peptide sequence
RKRLGIENPHR

SEQ ID NO: 7399 - protein, 11 aa, Artificial
  IGFBP-2 heparin binding domain-containing peptide sequence
HKRLGIENPHR

SEQ ID NO: 7400 - protein, 11 aa, Artificial
  IGFBP-2 heparin binding domain-containing peptide sequence
KRRLGIENPHR

SEQ ID NO: 7401 - protein, 11 aa, Artificial
  IGFBP-2 heparin binding domain-containing peptide sequence
RRRLGIENPHR

SEQ ID NO: 7402 - protein, 11 aa, Artificial
  IGFBP-2 heparin binding domain-containing peptide sequence
HRRLGIENPHR

SEQ ID NO: 7403 - protein, 11 aa, Artificial
  IGFBP-2 heparin binding domain-containing peptide sequence
KHHIGIENPHR

SEQ ID NO: 7404 - protein, 11 aa, Artificial
  IGFBP-2 heparin binding domain-containing peptide sequence
RHHIGIENPHR

SEQ ID NO: 7405 - protein, 11 aa, Artificial
  IGFBP-2 heparin binding domain-containing peptide sequence
HHHIGIENPHR

SEQ ID NO: 7406 - protein, 11 aa, Artificial
  IGFBP-2 heparin binding domain-containing peptide sequence
KKHIGIENPHR

SEQ ID NO: 7407 - protein, 11 aa, Artificial
  IGFBP-2 heparin binding domain-containing peptide sequence
RKHIGIENPHR

SEQ ID NO: 7408 - protein, 11 aa, Artificial
  IGFBP-2 heparin binding domain-containing peptide sequence
HKHIGIENPHR

SEQ ID NO: 7409 - protein, 11 aa, Artificial
  IGFBP-2 heparin binding domain-containing peptide sequence
KRHIGIENPHR

SEQ ID NO: 7410 - protein, 11 aa, Artificial
  IGFBP-2 heparin binding domain-containing peptide sequence
RRHIGIENPHR

SEQ ID NO: 7411 - protein, 11 aa, Artificial
  IGFBP-2 heparin binding domain-containing peptide sequence
HRHIGIENPHR

SEQ ID NO: 7412 - protein, 11 aa, Artificial
  IGFBP-2 heparin binding domain-containing peptide sequence
KHKIGIENPHR

SEQ ID NO: 7413 - protein, 11 aa, Artificial
  IGFBP-2 heparin binding domain-containing peptide sequence
RHKIGIENPHR

SEQ ID NO: 7414 - protein, 11 aa, Artificial
  IGFBP-2 heparin binding domain-containing peptide sequence
HHKIGIENPHR

SEQ ID NO: 7415 - protein, 11 aa, Artificial
  IGFBP-2 heparin binding domain-containing peptide sequence
KKKIGIENPHR

SEQ ID NO: 7416 - protein, 11 aa, Artificial
  IGFBP-2 heparin binding domain-containing peptide sequence
RKKIGIENPHR

SEQ ID NO: 7417 - protein, 11 aa, Artificial
  IGFBP-2 heparin binding domain-containing peptide sequence
HKKIGIENPHR

SEQ ID NO: 7418 - protein, 11 aa, Artificial
  IGFBP-2 heparin binding domain-containing peptide sequence
KRKIGIENPHR

SEQ ID NO: 7419 - protein, 11 aa, Artificial
  IGFBP-2 heparin binding domain-containing peptide sequence
RRKIGIENPHR

SEQ ID NO: 7420 - protein, 11 aa, Artificial
  IGFBP-2 heparin binding domain-containing peptide sequence
HRKIGIENPHR

SEQ ID NO: 7421 - protein, 11 aa, Artificial
  IGFBP-2 heparin binding domain-containing peptide sequence
KHRIGIENPHR

SEQ ID NO: 7422 - protein, 11 aa, Artificial
  IGFBP-2 heparin binding domain-containing peptide sequence
RHRIGIENPHR

SEQ ID NO: 7423 - protein, 11 aa, Artificial
  IGFBP-2 heparin binding domain-containing peptide sequence
HHRIGIENPHR

SEQ ID NO: 7424 - protein, 11 aa, Artificial
  IGFBP-2 heparin binding domain-containing peptide sequence
KKRIGIENPHR

SEQ ID NO: 7425 - protein, 11 aa, Artificial
  IGFBP-2 heparin binding domain-containing peptide sequence
RKRIGIENPHR

SEQ ID NO: 7426 - protein, 11 aa, Artificial
  IGFBP-2 heparin binding domain-containing peptide sequence
HKRIGIENPHR

SEQ ID NO: 7427 - protein, 11 aa, Artificial
  IGFBP-2 heparin binding domain-containing peptide sequence
KRRIGIENPHR

SEQ ID NO: 7428 - protein, 11 aa, Artificial
  IGFBP-2 heparin binding domain-containing peptide sequence
RRRIGIENPHR

SEQ ID NO: 7429 - protein, 11 aa, Artificial
  IGFBP-2 heparin binding domain-containing peptide sequence
HRRIGIENPHR

SEQ ID NO: 7430 - protein, 11 aa, Artificial
  IGFBP-2 heparin binding domain-containing peptide sequence
KHHVGIENPHR

SEQ ID NO: 7431 - protein, 11 aa, Artificial
  IGFBP-2 heparin binding domain-containing peptide sequence
RHHVGIENPHR

SEQ ID NO: 7432 - protein, 11 aa, Artificial
  IGFBP-2 heparin binding domain-containing peptide sequence
HHHVGIENPHR

SEQ ID NO: 7433 - protein, 11 aa, Artificial
  IGFBP-2 heparin binding domain-containing peptide sequence
KKHVGIENPHR

SEQ ID NO: 7434 - protein, 11 aa, Artificial
  IGFBP-2 heparin binding domain-containing peptide sequence
RKHVGIENPHR

SEQ ID NO: 7435 - protein, 11 aa, Artificial
  IGFBP-2 heparin binding domain-containing peptide sequence
HKHVGIENPHR

SEQ ID NO: 7436 - protein, 11 aa, Artificial
  IGFBP-2 heparin binding domain-containing peptide sequence
KRHVGIENPHR

SEQ ID NO: 7437 - protein, 11 aa, Artificial
  IGFBP-2 heparin binding domain-containing peptide sequence
RRHVGIENPHR

SEQ ID NO: 7438 - protein, 11 aa, Artificial
  IGFBP-2 heparin binding domain-containing peptide sequence
HRHVGIENPHR

SEQ ID NO: 7439 - protein, 11 aa, Artificial
  IGFBP-2 heparin binding domain-containing peptide sequence
KHKVGIENPHR

SEQ ID NO: 7440 - protein, 11 aa, Artificial
  IGFBP-2 heparin binding domain-containing peptide sequence
RHKVGIENPHR

SEQ ID NO: 7441 - protein, 11 aa, Artificial
  IGFBP-2 heparin binding domain-containing peptide sequence
HHKVGIENPHR

SEQ ID NO: 7442 - protein, 11 aa, Artificial
  IGFBP-2 heparin binding domain-containing peptide sequence
KKKVGIENPHR

SEQ ID NO: 7443 - protein, 11 aa, Artificial
  IGFBP-2 heparin binding domain-containing peptide sequence
RKKVGIENPHR

SEQ ID NO: 7444 - protein, 11 aa, Artificial
  IGFBP-2 heparin binding domain-containing peptide sequence
HKKVGIENPHR

SEQ ID NO: 7445 - protein, 11 aa, Artificial
  IGFBP-2 heparin binding domain-containing peptide sequence
KRKVGIENPHR

SEQ ID NO: 7446 - protein, 11 aa, Artificial
  IGFBP-2 heparin binding domain-containing peptide sequence
RRKVGIENPHR

SEQ ID NO: 7447 - protein, 11 aa, Artificial
  IGFBP-2 heparin binding domain-containing peptide sequence
HRKVGIENPHR

SEQ ID NO: 7448 - protein, 11 aa, Artificial
  IGFBP-2 heparin binding domain-containing peptide sequence
KHRVGIENPHR

SEQ ID NO: 7449 - protein, 11 aa, Artificial
  IGFBP-2 heparin binding domain-containing peptide sequence
RHRVGIENPHR

SEQ ID NO: 7450 - protein, 11 aa, Artificial
  IGFBP-2 heparin binding domain-containing peptide sequence
HHRVGIENPHR

SEQ ID NO: 7451 - protein, 11 aa, Artificial
  IGFBP-2 heparin binding domain-containing peptide sequence
KKRVGIENPHR

SEQ ID NO: 7452 - protein, 11 aa, Artificial
  IGFBP-2 heparin binding domain-containing peptide sequence
RKRVGIENPHR

SEQ ID NO: 7453 - protein, 11 aa, Artificial
  IGFBP-2 heparin binding domain-containing peptide sequence
HKRVGIENPHR

SEQ ID NO: 7454 - protein, 11 aa, Artificial
  IGFBP-2 heparin binding domain-containing peptide sequence
KRRVGIENPHR

SEQ ID NO: 7455 - protein, 11 aa, Artificial
  IGFBP-2 heparin binding domain-containing peptide sequence
RRRVGIENPHR

SEQ ID NO: 7456 - protein, 11 aa, Artificial
  IGFBP-2 heparin binding domain-containing peptide sequence
HRRVGIENPHR

SEQ ID NO: 7457 - protein, 11 aa, Artificial
  IGFBP-2 heparin binding domain-containing peptide sequence
KHHLGVENPHR

SEQ ID NO: 7458 - protein, 11 aa, Artificial
  IGFBP-2 heparin binding domain-containing peptide sequence
RHHLGVENPHR

SEQ ID NO: 7459 - protein, 11 aa, Artificial
  IGFBP-2 heparin binding domain-containing peptide sequence
HHHLGVENPHR

SEQ ID NO: 7460 - protein, 11 aa, Artificial
  IGFBP-2 heparin binding domain-containing peptide sequence
KKHLGVENPHR

SEQ ID NO: 7461 - protein, 11 aa, Artificial
  IGFBP-2 heparin binding domain-containing peptide sequence
RKHLGVENPHR

SEQ ID NO: 7462 - protein, 11 aa, Artificial
  IGFBP-2 heparin binding domain-containing peptide sequence
HKHLGVENPHR

SEQ ID NO: 7463 - protein, 11 aa, Artificial
  IGFBP-2 heparin binding domain-containing peptide sequence
KRHLGVENPHR

SEQ ID NO: 7464 - protein, 11 aa, Artificial
  IGFBP-2 heparin binding domain-containing peptide sequence
RRHLGVENPHR

SEQ ID NO: 7465 - protein, 11 aa, Artificial
  IGFBP-2 heparin binding domain-containing peptide sequence
HRHLGVENPHR

SEQ ID NO: 7466 - protein, 11 aa, Artificial
  IGFBP-2 heparin binding domain-containing peptide sequence
KHKLGVENPHR

SEQ ID NO: 7467 - protein, 11 aa, Artificial
  IGFBP-2 heparin binding domain-containing peptide sequence
RHKLGVENPHR

SEQ ID NO: 7468 - protein, 11 aa, Artificial
  IGFBP-2 heparin binding domain-containing peptide sequence
HHKLGVENPHR

SEQ ID NO: 7469 - protein, 11 aa, Artificial
  IGFBP-2 heparin binding domain-containing peptide sequence
KKKLGVENPHR

SEQ ID NO: 7470 - protein, 11 aa, Artificial
  IGFBP-2 heparin binding domain-containing peptide sequence
RKKLGVENPHR

SEQ ID NO: 7471 - protein, 11 aa, Artificial
  IGFBP-2 heparin binding domain-containing peptide sequence
HKKLGVENPHR

SEQ ID NO: 7472 - protein, 11 aa, Artificial
  IGFBP-2 heparin binding domain-containing peptide sequence
KRKLGVENPHR

SEQ ID NO: 7473 - protein, 11 aa, Artificial
  IGFBP-2 heparin binding domain-containing peptide sequence
RRKLGVENPHR

SEQ ID NO: 7474 - protein, 11 aa, Artificial
  IGFBP-2 heparin binding domain-containing peptide sequence
HRKLGVENPHR

SEQ ID NO: 7475 - protein, 11 aa, Artificial
  IGFBP-2 heparin binding domain-containing peptide sequence
KHRLGVENPHR

SEQ ID NO: 7476 - protein, 11 aa, Artificial
  IGFBP-2 heparin binding domain-containing peptide sequence
RHRLGVENPHR

SEQ ID NO: 7477 - protein, 11 aa, Artificial
  IGFBP-2 heparin binding domain-containing peptide sequence
HHRLGVENPHR

SEQ ID NO: 7478 - protein, 11 aa, Artificial
  IGFBP-2 heparin binding domain-containing peptide sequence
KKRLGVENPHR

SEQ ID NO: 7479 - protein, 11 aa, Artificial
  IGFBP-2 heparin binding domain-containing peptide sequence
RKRLGVENPHR

SEQ ID NO: 7480 - protein, 11 aa, Artificial
  IGFBP-2 heparin binding domain-containing peptide sequence
HKRLGVENPHR

SEQ ID NO: 7481 - protein, 11 aa, Artificial
  IGFBP-2 heparin binding domain-containing peptide sequence
KRRLGVENPHR

SEQ ID NO: 7482 - protein, 11 aa, Artificial
  IGFBP-2 heparin binding domain-containing peptide sequence
RRRLGVENPHR

SEQ ID NO: 7483 - protein, 11 aa, Artificial
  IGFBP-2 heparin binding domain-containing peptide sequence
HRRLGVENPHR

SEQ ID NO: 7484 - protein, 11 aa, Artificial
  IGFBP-2 heparin binding domain-containing peptide sequence
KHHIGVENPHR

SEQ ID NO: 7485 - protein, 11 aa, Artificial
  IGFBP-2 heparin binding domain-containing peptide sequence
RHHIGVEEPHR

SEQ ID NO: 7486 - protein, 11 aa, Artificial
  IGFBP-2 heparin binding domain-containing peptide sequence
HHHIGVENPHR

SEQ ID NO: 7487 - protein, 11 aa, Artificial
  IGFBP-2 heparin binding domain-containing peptide sequence
KKHIGVENPHR

SEQ ID NO: 7488 - protein, 11 aa, Artificial
  IGFBP-2 heparin binding domain-containing peptide sequence
RKHIGVENPHR

SEQ ID NO: 7489 - protein, 11 aa, Artificial
  IGFBP-2 heparin binding domain-containing peptide sequence
HKHIGVENPHR

SEQ ID NO: 7490 - protein, 11 aa, Artificial
  IGFBP-2 heparin binding domain-containing peptide sequence
KRHIGVENPHR

SEQ ID NO: 7491 - protein, 11 aa, Artificial
  IGFBP-2 heparin binding domain-containing peptide sequence
RRHIGVENPHR

SEQ ID NO: 7492 - protein, 11 aa, Artificial
  IGFBP-2 heparin binding domain-containing peptide sequence
HRHIGVENPHR

SEQ ID NO: 7493 - protein, 11 aa, Artificial
  IGFBP-2 heparin binding domain-containing peptide sequence
KHKIGVENPHR

SEQ ID NO: 7494 - protein, 11 aa, Artificial
  IGFBP-2 heparin binding domain-containing peptide sequence
RHKIGVENPHR

SEQ ID NO: 7495 - protein, 11 aa, Artificial
  IGFBP-2 heparin binding domain-containing peptide sequence
HHKIGVENPHR

SEQ ID NO: 7496 - protein, 11 aa, Artificial
  IGFBP-2 heparin binding domain-containing peptide sequence
KKKIGVENPHR

SEQ ID NO: 7497 - protein, 11 aa, Artificial
  IGFBP-2 heparin binding domain-containing peptide sequence
RKKIGVENPHR

SEQ ID NO: 7498 - protein, 11 aa, Artificial
  IGFBP-2 heparin binding domain-containing peptide sequence
HKKIGVENPHR

SEQ ID NO: 7499 - protein, 11 aa, Artificial
  IGFBP-2 heparin binding domain-containing peptide sequence
KRKIGVENPHR

SEQ ID NO: 7500 - protein, 11 aa, Artificial
  IGFBP-2 heparin binding domain-containing peptide sequence
RRKIGVENPHR

SEQ ID NO: 7501 - protein, 11 aa, Artificial
  IGFBP-2 heparin binding domain-containing peptide sequence
HRKIGVENPHR

SEQ ID NO: 7502 - protein, 11 aa, Artificial
  IGFBP-2 heparin binding domain-containing peptide sequence
KHRIGVENPHR

SEQ ID NO: 7503 - protein, 11 aa, Artificial
  IGFBP-2 heparin binding domain-containing peptide sequence
RHRIGVENPHR

SEQ ID NO: 7504 - protein, 11 aa, Artificial
  IGFBP-2 heparin binding domain-containing peptide sequence
HHRIGVENPHR

SEQ ID NO: 7505 - protein, 11 aa, Artificial
  IGFBP-2 heparin binding domain-containing peptide sequence
KKRIGVENPHR

SEQ ID NO: 7506 - protein, 11 aa, Artificial
  IGFBP-2 heparin binding domain-containing peptide sequence
RKRIGVENPHR

SEQ ID NO: 7507 - protein, 11 aa, Artificial
  IGFBP-2 heparin binding domain-containing peptide sequence
HKRIGVENPHR

SEQ ID NO: 7508 - protein, 11 aa, Artificial
  IGFBP-2 heparin binding domain-containing peptide sequence
KRRIGVENPHR

SEQ ID NO: 7509 - protein, 11 aa, Artificial
  IGFBP-2 heparin binding domain-containing peptide sequence
RRRIGVENPHR

SEQ ID NO: 7510 - protein, 11 aa, Artificial
  IGFBP-2 heparin binding domain-containing peptide sequence
HRRIGVENPHR

SEQ ID NO: 7511 - protein, 11 aa, Artificial
  IGFBP-2 heparin binding domain-containing peptide sequence
KHHVGVENPHR

SEQ ID NO: 7512 - protein, 11 aa, Artificial
  IGFBP-2 heparin binding domain-containing peptide sequence
RHHVGVENPHR

SEQ ID NO: 7513 - protein, 11 aa, Artificial
  IGFBP-2 heparin binding domain-containing peptide sequence
HHHVGVENPHR

SEQ ID NO: 7514 - protein, 11 aa, Artificial
  IGFBP-2 heparin binding domain-containing peptide sequence
KKHVGVENPHR

SEQ ID NO: 7515 - protein, 11 aa, Artificial
  IGFBP-2 heparin binding domain-containing peptide sequence
RKHVGVENPHR

SEQ ID NO: 7516 - protein, 11 aa, Artificial
  IGFBP-2 heparin binding domain-containing peptide sequence
HKHVGVENPHR

SEQ ID NO: 7517 - protein, 11 aa, Artificial
  IGFBP-2 heparin binding domain-containing peptide sequence
KRHVGVENPHR

SEQ ID NO: 7518 - protein, 11 aa, Artificial
  IGFBP-2 heparin binding domain-containing peptide sequence
RRHVGVENPHR

SEQ ID NO: 7519 - protein, 11 aa, Artificial
  IGFBP-2 heparin binding domain-containing peptide sequence
HRHVGVENPHR

SEQ ID NO: 7520 - protein, 11 aa, Artificial
  IGFBP-2 heparin binding domain-containing peptide sequence
KHKVGVENPHR

SEQ ID NO: 7521 - protein, 11 aa, Artificial
  IGFBP-2 heparin binding domain-containing peptide sequence
RHKVGVENPHR

SEQ ID NO: 7522 - protein, 11 aa, Artificial
  IGFBP-2 heparin binding domain-containing peptide sequence
HHKVGVENPHR

SEQ ID NO: 7523 - protein, 11 aa, Artificial
  IGFBP-2 heparin binding domain-containing peptide sequence
KKKVGVENPHR

SEQ ID NO: 7524 - protein, 11 aa, Artificial
  IGFBP-2 heparin binding domain-containing peptide sequence
RKKVGVENPHR

SEQ ID NO: 7525 - protein, 11 aa, Artificial
  IGFBP-2 heparin binding domain-containing peptide sequence
HKKVGVENPHR

SEQ ID NO: 7526 - protein, 11 aa, Artificial
  IGFBP-2 heparin binding domain-containing peptide sequence
KRKVGVENPHR

SEQ ID NO: 7527 - protein, 11 aa, Artificial
  IGFBP-2 heparin binding domain-containing peptide sequence
RRKVGVEEPHR

SEQ ID NO: 7528 - protein, 11 aa, Artificial
  IGFBP-2 heparin binding domain-containing peptide sequence
HRKVGVENPHR

SEQ ID NO: 7529 - protein, 11 aa, Artificial
  IGFBP-2 heparin binding domain-containing peptide sequence
KHRVGVENPHR

SEQ ID NO: 7530 - protein, 11 aa, Artificial
  IGFBP-2 heparin binding domain-containing peptide sequence
RHRVGVENPHR

SEQ ID NO: 7531 - protein, 11 aa, Artificial
  IGFBP-2 heparin binding domain-containing peptide sequence
HHRVGVENPHR

SEQ ID NO: 7532 - protein, 11 aa, Artificial
  IGFBP-2 heparin binding domain-containing peptide sequence
KKRVGVENPHR

SEQ ID NO: 7533 - protein, 11 aa, Artificial
  IGFBP-2 heparin binding domain-containing peptide sequence
RKRVGVENPHR

SEQ ID NO: 7534 - protein, 11 aa, Artificial
  IGFBP-2 heparin binding domain-containing peptide sequence
HKRVGVENPHR

SEQ ID NO: 7535 - protein, 11 aa, Artificial
  IGFBP-2 heparin binding domain-containing peptide sequence
KRRVGVENPHR

SEQ ID NO: 7536 - protein, 11 aa, Artificial
  IGFBP-2 heparin binding domain-containing peptide sequence
RRRVGVENPHR

SEQ ID NO: 7537 - protein, 11 aa, Artificial
  IGFBP-2 heparin binding domain-containing peptide sequence
HRRVGVENPHR

SEQ ID NO: 7538 - protein, 11 aa, Artificial
  IGFBP-2 heparin binding domain-containing peptide sequence
KHHLGLNNPHR

SEQ ID NO: 7539 - protein, 11 aa, Artificial
  IGFBP-2 heparin binding domain-containing peptide sequence
RHHLGLNNPHR

SEQ ID NO: 7540 - protein, 11 aa, Artificial
  IGFBP-2 heparin binding domain-containing peptide sequence
HHHLGLNNPHR

SEQ ID NO: 7541 - protein, 11 aa, Artificial
  IGFBP-2 heparin binding domain-containing peptide sequence
KKHLGLNNPHR

SEQ ID NO: 7542 - protein, 11 aa, Artificial
  IGFBP-2 heparin binding domain-containing peptide sequence
RKHLGLNNPHR

SEQ ID NO: 7543 - protein, 11 aa, Artificial
  IGFBP-2 heparin binding domain-containing peptide sequence
HKHLGLNNPHR

SEQ ID NO: 7544 - protein, 11 aa, Artificial
  IGFBP-2 heparin binding domain-containing peptide sequence
KRHLGLNNPHR

SEQ ID NO: 7545 - protein, 11 aa, Artificial
  IGFBP-2 heparin binding domain-containing peptide sequence
RRHLGLNNPHR

SEQ ID NO: 7546 - protein, 11 aa, Artificial
  IGFBP-2 heparin binding domain-containing peptide sequence
HRHLGLNNPHR

SEQ ID NO: 7547 - protein, 11 aa, Artificial
  IGFBP-2 heparin binding domain-containing peptide sequence
KHKLGLNNPHR

SEQ ID NO: 7548 - protein, 11 aa, Artificial
  IGFBP-2 heparin binding domain-containing peptide sequence
RHKLGLNNPHR

SEQ ID NO: 7549 - protein, 11 aa, Artificial
  IGFBP-2 heparin binding domain-containing peptide sequence
HHKLGLNNPHR

SEQ ID NO: 7550 - protein, 11 aa, Artificial
  IGFBP-2 heparin binding domain-containing peptide sequence
KKKLGLNNPHR

SEQ ID NO: 7551 - protein, 11 aa, Artificial
  IGFBP-2 heparin binding domain-containing peptide sequence
RKKLGLNNPHR

SEQ ID NO: 7552 - protein, 11 aa, Artificial
  IGFBP-2 heparin binding domain-containing peptide sequence
HKKLGLNNPHR

SEQ ID NO: 7553 - protein, 11 aa, Artificial
  IGFBP-2 heparin binding domain-containing peptide sequence
KRKLGLNNPHR

SEQ ID NO: 7554 - protein, 11 aa, Artificial
  IGFBP-2 heparin binding domain-containing peptide sequence
RRKLGLNNPHR

SEQ ID NO: 7555 - protein, 11 aa, Artificial
  IGFBP-2 heparin binding domain-containing peptide sequence
HRKLGLNNPHR

SEQ ID NO: 7556 - protein, 11 aa, Artificial
  IGFBP-2 heparin binding domain-containing peptide sequence
KHRLGLNNPHR

SEQ ID NO: 7557 - protein, 11 aa, Artificial
  IGFBP-2 heparin binding domain-containing peptide sequence
RHRLGLNNPHR

SEQ ID NO: 7558 - protein, 11 aa, Artificial
  IGFBP-2 heparin binding domain-containing peptide sequence
HHRLGLNNPHR

SEQ ID NO: 7559 - protein, 11 aa, Artificial
  IGFBP-2 heparin binding domain-containing peptide sequence
KKRLGLNNPHR

SEQ ID NO: 7560 - protein, 11 aa, Artificial
  IGFBP-2 heparin binding domain-containing peptide sequence
RKRLGLNNPHR

SEQ ID NO: 7561 - protein, 11 aa, Artificial
  IGFBP-2 heparin binding domain-containing peptide sequence
HKRLGLNNPHR

SEQ ID NO: 7562 - protein, 11 aa, Artificial
  IGFBP-2 heparin binding domain-containing peptide sequence
KRRLGLNNPHR

SEQ ID NO: 7563 - protein, 11 aa, Artificial
  IGFBP-2 heparin binding domain-containing peptide sequence
RRRLGLNNPHR

SEQ ID NO: 7564 - protein, 11 aa, Artificial
  IGFBP-2 heparin binding domain-containing peptide sequence
HRRLGLNNPHR

SEQ ID NO: 7565 - protein, 11 aa, Artificial
  IGFBP-2 heparin binding domain-containing peptide sequence
KHHIGLNNPHR

SEQ ID NO: 7566 - protein, 11 aa, Artificial
  IGFBP-2 heparin binding domain-containing peptide sequence
RHHIGLNNPHR

SEQ ID NO: 7567 - protein, 11 aa, Artificial
  IGFBP-2 heparin binding domain-containing peptide sequence
HHHIGLNNPHR

SEQ ID NO: 7568 - protein, 11 aa, Artificial
  IGFBP-2 heparin binding domain-containing peptide sequence
KKHIGLNNPHR

SEQ ID NO: 7569 - protein, 11 aa, Artificial
  IGFBP-2 heparin binding domain-containing peptide sequence
RKHIGLNNPHR

SEQ ID NO: 7570 - protein, 11 aa, Artificial
  IGFBP-2 heparin binding domain-containing peptide sequence
HKHIGLNNPHR

SEQ ID NO: 7571 - protein, 11 aa, Artificial
  IGFBP-2 heparin binding domain-containing peptide sequence
KRHIGLNNPHR

SEQ ID NO: 7572 - protein, 11 aa, Artificial
  IGFBP-2 heparin binding domain-containing peptide sequence
RRHIGLNNPHR

SEQ ID NO: 7573 - protein, 11 aa, Artificial
  IGFBP-2 heparin binding domain-containing peptide sequence
HRHIGLNNPHR

SEQ ID NO: 7574 - protein, 11 aa, Artificial
  IGFBP-2 heparin binding domain-containing peptide sequence
KHKIGLNNPHR

SEQ ID NO: 7575 - protein, 11 aa, Artificial
  IGFBP-2 heparin binding domain-containing peptide sequence
RHKIGLNNPHR

SEQ ID NO: 7576 - protein, 11 aa, Artificial
  IGFBP-2 heparin binding domain-containing peptide sequence
HHKIGLNNPHR

SEQ ID NO: 7577 - protein, 11 aa, Artificial
  IGFBP-2 heparin binding domain-containing peptide sequence
KKKIGLNNPHR

SEQ ID NO: 7578 - protein, 11 aa, Artificial
  IGFBP-2 heparin binding domain-containing peptide sequence
RKKIGLNNPHR

SEQ ID NO: 7579 - protein, 11 aa, Artificial
  IGFBP-2 heparin binding domain-containing peptide sequence
HKKIGLNNPHR

SEQ ID NO: 7580 - protein, 11 aa, Artificial
  IGFBP-2 heparin binding domain-containing peptide sequence
KRKIGLNNPHR

SEQ ID NO: 7581 - protein, 11 aa, Artificial
  IGFBP-2 heparin binding domain-containing peptide sequence
RRKIGLNNPHR

SEQ ID NO: 7582 - protein, 11 aa, Artificial
  IGFBP-2 heparin binding domain-containing peptide sequence
HRKIGLNNPHR

SEQ ID NO: 7583 - protein, 11 aa, Artificial
  IGFBP-2 heparin binding domain-containing peptide sequence
KHRIGLNNPHR

SEQ ID NO: 7584 - protein, 11 aa, Artificial
  IGFBP-2 heparin binding domain-containing peptide sequence
RHRIGLNNPHR

SEQ ID NO: 7585 - protein, 11 aa, Artificial
  IGFBP-2 heparin binding domain-containing peptide sequence
HHRIGLNNPHR

SEQ ID NO: 7586 - protein, 11 aa, Artificial
  IGFBP-2 heparin binding domain-containing peptide sequence
KKRIGLNNPHR

SEQ ID NO: 7587 - protein, 11 aa, Artificial
  IGFBP-2 heparin binding domain-containing peptide sequence
RKRIGLNNPHR

SEQ ID NO: 7588 - protein, 11 aa, Artificial
  IGFBP-2 heparin binding domain-containing peptide sequence
HKRIGLNNPHR

SEQ ID NO: 7589 - protein, 11 aa, Artificial
  IGFBP-2 heparin binding domain-containing peptide sequence
KRRIGLNNPHR

SEQ ID NO: 7590 - protein, 11 aa, Artificial
  IGFBP-2 heparin binding domain-containing peptide sequence
RRRIGLNNPHR

SEQ ID NO: 7591 - protein, 11 aa, Artificial
  IGFBP-2 heparin binding domain-containing peptide sequence
HRRIGLNNPHR

SEQ ID NO: 7592 - protein, 11 aa, Artificial
  IGFBP-2 heparin binding domain-containing peptide sequence
KHHVGLNNPHR

SEQ ID NO: 7593 - protein, 11 aa, Artificial
  IGFBP-2 heparin binding domain-containing peptide sequence
RHHVGLNNPHR

SEQ ID NO: 7594 - protein, 11 aa, Artificial
  IGFBP-2 heparin binding domain-containing peptide sequence
HHHVGLNNPHR

SEQ ID NO: 7595 - protein, 11 aa, Artificial
  IGFBP-2 heparin binding domain-containing peptide sequence
KKHVGLNNPHR

SEQ ID NO: 7596 - protein, 11 aa, Artificial
  IGFBP-2 heparin binding domain-containing peptide sequence
RKHVGLNNPHR

SEQ ID NO: 7597 - protein, 11 aa, Artificial
  IGFBP-2 heparin binding domain-containing peptide sequence
HKHVGLNNPHR

SEQ ID NO: 7598 - protein, 11 aa, Artificial
  IGFBP-2 heparin binding domain-containing peptide sequence
KRHVGLNNPHR

SEQ ID NO: 7599 - protein, 11 aa, Artificial
  IGFBP-2 heparin binding domain-containing peptide sequence
RRHVGLNNPHR

SEQ ID NO: 7600 - protein, 11 aa, Artificial
  IGFBP-2 heparin binding domain-containing peptide sequence
HRHVGLNNPHR

SEQ ID NO: 7601 - protein, 11 aa, Artificial
  IGFBP-2 heparin binding domain-containing peptide sequence
KHKVGLNNPHR

SEQ ID NO: 7602 - protein, 11 aa, Artificial
  IGFBP-2 heparin binding domain-containing peptide sequence
RHKVGLNNPHR

SEQ ID NO: 7603 - protein, 11 aa, Artificial
  IGFBP-2 heparin binding domain-containing peptide sequence
HHKVGLNNPHR

SEQ ID NO: 7604 - protein, 11 aa, Artificial
  IGFBP-2 heparin binding domain-containing peptide sequence
KKKVGLNNPHR

SEQ ID NO: 7605 - protein, 11 aa, Artificial
  IGFBP-2 heparin binding domain-containing peptide sequence
RKKVGLNNPHR

SEQ ID NO: 7606 - protein, 11 aa, Artificial
  IGFBP-2 heparin binding domain-containing peptide sequence
HKKVGLNNPHR

SEQ ID NO: 7607 - protein, 11 aa, Artificial
  IGFBP-2 heparin binding domain-containing peptide sequence
KRKVGLNNPHR

SEQ ID NO: 7608 - protein, 11 aa, Artificial
  IGFBP-2 heparin binding domain-containing peptide sequence
RRKVGLNNPHR

SEQ ID NO: 7609 - protein, 11 aa, Artificial
  IGFBP-2 heparin binding domain-containing peptide sequence
HRKVGLNNPHR

SEQ ID NO: 7610 - protein, 11 aa, Artificial
  IGFBP-2 heparin binding domain-containing peptide sequence
KHRVGLNNPHR

SEQ ID NO: 7611 - protein, 11 aa, Artificial
  IGFBP-2 heparin binding domain-containing peptide sequence
RHRVGLNNPHR

SEQ ID NO: 7612 - protein, 11 aa, Artificial
  IGFBP-2 heparin binding domain-containing peptide sequence
HHRVGLNNPHR

SEQ ID NO: 7613 - protein, 11 aa, Artificial
  IGFBP-2 heparin binding domain-containing peptide sequence
KKRVGLNNPHR

SEQ ID NO: 7614 - protein, 11 aa, Artificial
  IGFBP-2 heparin binding domain-containing peptide sequence
RKRVGLNNPHR

SEQ ID NO: 7615 - protein, 11 aa, Artificial
  IGFBP-2 heparin binding domain-containing peptide sequence
HKRVGLNNPHR

SEQ ID NO: 7616 - protein, 11 aa, Artificial
  IGFBP-2 heparin binding domain-containing peptide sequence
KRRVGLNNPHR

SEQ ID NO: 7617 - protein, 11 aa, Artificial
  IGFBP-2 heparin binding domain-containing peptide sequence
RRRVGLNNPHR

SEQ ID NO: 7618 - protein, 11 aa, Artificial
  IGFBP-2 heparin binding domain-containing peptide sequence
HRRVGLNNPHR

SEQ ID NO: 7619 - protein, 11 aa, Artificial
  IGFBP-2 heparin binding domain-containing peptide sequence
KHHLGINNPHR

SEQ ID NO: 7620 - protein, 11 aa, Artificial
  IGFBP-2 heparin binding domain-containing peptide sequence
RHHLGINNPHR

SEQ ID NO: 7621 - protein, 11 aa, Artificial
  IGFBP-2 heparin binding domain-containing peptide sequence
HHHLGINNPHR

SEQ ID NO: 7622 - protein, 11 aa, Artificial
  IGFBP-2 heparin binding domain-containing peptide sequence
KKHLGINNPHR

SEQ ID NO: 7623 - protein, 11 aa, Artificial
  IGFBP-2 heparin binding domain-containing peptide sequence
RKHLGINNPHR

SEQ ID NO: 7624 - protein, 11 aa, Artificial
  IGFBP-2 heparin binding domain-containing peptide sequence
HKHLGINNPHR

SEQ ID NO: 7625 - protein, 11 aa, Artificial
  IGFBP-2 heparin binding domain-containing peptide sequence
KRHLGINNPHR

SEQ ID NO: 7626 - protein, 11 aa, Artificial
  IGFBP-2 heparin binding domain-containing peptide sequence
RRHLGINNPHR

SEQ ID NO: 7627 - protein, 11 aa, Artificial
  IGFBP-2 heparin binding domain-containing peptide sequence
HRHLGINNPHR

SEQ ID NO: 7628 - protein, 11 aa, Artificial
  IGFBP-2 heparin binding domain-containing peptide sequence
KHKLGINNPHR

SEQ ID NO: 7629 - protein, 11 aa, Artificial
  IGFBP-2 heparin binding domain-containing peptide sequence
RHKLGINNPHR

SEQ ID NO: 7630 - protein, 11 aa, Artificial
  IGFBP-2 heparin binding domain-containing peptide sequence
HHKLGINNPHR

SEQ ID NO: 7631 - protein, 11 aa, Artificial
  IGFBP-2 heparin binding domain-containing peptide sequence
KKKLGINNPHR

SEQ ID NO: 7632 - protein, 11 aa, Artificial
  IGFBP-2 heparin binding domain-containing peptide sequence
RKKLGINNPHR

SEQ ID NO: 7633 - protein, 11 aa, Artificial
  IGFBP-2 heparin binding domain-containing peptide sequence
HKKLGINNPHR

SEQ ID NO: 7634 - protein, 11 aa, Artificial
  IGFBP-2 heparin binding domain-containing peptide sequence
KRKLGINNPHR

SEQ ID NO: 7635 - protein, 11 aa, Artificial
  IGFBP-2 heparin binding domain-containing peptide sequence
RRKLGINNPHR

SEQ ID NO: 7636 - protein, 11 aa, Artificial
  IGFBP-2 heparin binding domain-containing peptide sequence
HRKLGINNPHR

SEQ ID NO: 7637 - protein, 11 aa, Artificial
  IGFBP-2 heparin binding domain-containing peptide sequence
KHRLGINNPHR

SEQ ID NO: 7638 - protein, 11 aa, Artificial
  IGFBP-2 heparin binding domain-containing peptide sequence
RHRLGINNPHR

SEQ ID NO: 7639 - protein, 11 aa, Artificial
  IGFBP-2 heparin binding domain-containing peptide sequence
HHRLGINNPHR

SEQ ID NO: 7640 - protein, 11 aa, Artificial
  IGFBP-2 heparin binding domain-containing peptide sequence
KKRLGINNPHR

SEQ ID NO: 7641 - protein, 11 aa, Artificial
  IGFBP-2 heparin binding domain-containing peptide sequence
RKRLGINNPHR

SEQ ID NO: 7642 - protein, 11 aa, Artificial
  IGFBP-2 heparin binding domain-containing peptide sequence
HKRLGINNPHR

SEQ ID NO: 7643 - protein, 11 aa, Artificial
  IGFBP-2 heparin binding domain-containing peptide sequence
KRRLGINNPHR

SEQ ID NO: 7644 - protein, 11 aa, Artificial
  IGFBP-2 heparin binding domain-containing peptide sequence
RRRLGINNPHR

SEQ ID NO: 7645 - protein, 11 aa, Artificial
  IGFBP-2 heparin binding domain-containing peptide sequence
HRRLGINNPHR

SEQ ID NO: 7646 - protein, 11 aa, Artificial
  IGFBP-2 heparin binding domain-containing peptide sequence
KHHIGIENPHR

SEQ ID NO: 7647 - protein, 11 aa, Artificial
  IGFBP-2 heparin binding domain-containing peptide sequence
RHHIGINNPHR

SEQ ID NO: 7648 - protein, 11 aa, Artificial
  IGFBP-2 heparin binding domain-containing peptide sequence
HHHIGINNPHR

SEQ ID NO: 7649 - protein, 11 aa, Artificial
  IGFBP-2 heparin binding domain-containing peptide sequence
KKHIGINNPHR

SEQ ID NO: 7650 - protein, 11 aa, Artificial
  IGFBP-2 heparin binding domain-containing peptide sequence
RKHIGINNPHR

SEQ ID NO: 7651 - protein, 11 aa, Artificial
  IGFBP-2 heparin binding domain-containing peptide sequence
HKHIGINNPHR

SEQ ID NO: 7652 - protein, 11 aa, Artificial
  IGFBP-2 heparin binding domain-containing peptide sequence
KRHIGINNPHR

SEQ ID NO: 7653 - protein, 11 aa, Artificial
  IGFBP-2 heparin binding domain-containing peptide sequence
RRHIGINNPHR

SEQ ID NO: 7654 - protein, 11 aa, Artificial
  IGFBP-2 heparin binding domain-containing peptide sequence
HRHIGINNPHR

SEQ ID NO: 7655 - protein, 11 aa, Artificial
  IGFBP-2 heparin binding domain-containing peptide sequence
KHKIGINNPHR

SEQ ID NO: 7656 - protein, 11 aa, Artificial
  IGFBP-2 heparin binding domain-containing peptide sequence
RHKIGINNPHR

SEQ ID NO: 7657 - protein, 11 aa, Artificial
  IGFBP-2 heparin binding domain-containing peptide sequence
HHKIGINNPHR

SEQ ID NO: 7658 - protein, 11 aa, Artificial
  IGFBP-2 heparin binding domain-containing peptide sequence
KKKIGINNPHR

SEQ ID NO: 7659 - protein, 11 aa, Artificial
  IGFBP-2 heparin binding domain-containing peptide sequence
RKKIGINNPHR

SEQ ID NO: 7660 - protein, 11 aa, Artificial
  IGFBP-2 heparin binding domain-containing peptide sequence
HKKIGINNPHR

SEQ ID NO: 7661 - protein, 11 aa, Artificial
  IGFBP-2 heparin binding domain-containing peptide sequence
KRKIGINNPHR

SEQ ID NO: 7662 - protein, 11 aa, Artificial
  IGFBP-2 heparin binding domain-containing peptide sequence
RRKIGINNPHR

SEQ ID NO: 7663 - protein, 11 aa, Artificial
  IGFBP-2 heparin binding domain-containing peptide sequence
HRKIGINNPHR

SEQ ID NO: 7664 - protein, 11 aa, Artificial
  IGFBP-2 heparin binding domain-containing peptide sequence
KHRIGINNPHR

SEQ ID NO: 7665 - protein, 11 aa, Artificial
  IGFBP-2 heparin binding domain-containing peptide sequence
RHRIGINNPHR

SEQ ID NO: 7666 - protein, 11 aa, Artificial
  IGFBP-2 heparin binding domain-containing peptide sequence
HHRIGINNPHR

SEQ ID NO: 7667 - protein, 11 aa, Artificial
  IGFBP-2 heparin binding domain-containing peptide sequence
KKRIGINNPHR

SEQ ID NO: 7668 - protein, 11 aa, Artificial
  IGFBP-2 heparin binding domain-containing peptide sequence
RKRIGINNPHR

SEQ ID NO: 7669 - protein, 11 aa, Artificial
  IGFBP-2 heparin binding domain-containing peptide sequence
HKRIGINNPHR

SEQ ID NO: 7670 - protein, 11 aa, Artificial
  IGFBP-2 heparin binding domain-containing peptide sequence
KRRIGINNPHR

SEQ ID NO: 7671 - protein, 11 aa, Artificial
  IGFBP-2 heparin binding domain-containing peptide sequence
RRRIGINNPHR

SEQ ID NO: 7672 - protein, 11 aa, Artificial
  IGFBP-2 heparin binding domain-containing peptide sequence
HRRIGINNPHR

SEQ ID NO: 7673 - protein, 11 aa, Artificial
  IGFBP-2 heparin binding domain-containing peptide sequence
KHHVGINNPHR

SEQ ID NO: 7674 - protein, 11 aa, Artificial
  IGFBP-2 heparin binding domain-containing peptide sequence
RHHVGINNPHR

SEQ ID NO: 7675 - protein, 11 aa, Artificial
  IGFBP-2 heparin binding domain-containing peptide sequence
HHHVGINNPHR

SEQ ID NO: 7676 - protein, 11 aa, Artificial
  IGFBP-2 heparin binding domain-containing peptide sequence
KKHVGINNPHR

SEQ ID NO: 7677 - protein, 11 aa, Artificial
  IGFBP-2 heparin binding domain-containing peptide sequence
RKHVGINNPHR

SEQ ID NO: 7678 - protein, 11 aa, Artificial
  IGFBP-2 heparin binding domain-containing peptide sequence
HKHVGINNPHR

SEQ ID NO: 7679 - protein, 11 aa, Artificial
  IGFBP-2 heparin binding domain-containing peptide sequence
KRHVGINNPHR

SEQ ID NO: 7680 - protein, 11 aa, Artificial
  IGFBP-2 heparin binding domain-containing peptide sequence
RRHVGINNPHR

SEQ ID NO: 7681 - protein, 11 aa, Artificial
  IGFBP-2 heparin binding domain-containing peptide sequence
HRHVGINNPHR

SEQ ID NO: 7682 - protein, 11 aa, Artificial
  IGFBP-2 heparin binding domain-containing peptide sequence
KHKVGINNPHR

SEQ ID NO: 7683 - protein, 11 aa, Artificial
  IGFBP-2 heparin binding domain-containing peptide sequence
RHKVGINNPHR

SEQ ID NO: 7684 - protein, 11 aa, Artificial
  IGFBP-2 heparin binding domain-containing peptide sequence
HHKVGINNPHR

SEQ ID NO: 7685 - protein, 11 aa, Artificial
  IGFBP-2 heparin binding domain-containing peptide sequence
KKKVGINNPHR

SEQ ID NO: 7686 - protein, 11 aa, Artificial
  IGFBP-2 heparin binding domain-containing peptide sequence
RKKVGINNPHR

SEQ ID NO: 7687 - protein, 11 aa, Artificial
  IGFBP-2 heparin binding domain-containing peptide sequence
HKKVGINNPHR

SEQ ID NO: 7688 - protein, 11 aa, Artificial
  IGFBP-2 heparin binding domain-containing peptide sequence
KRKVGINNPHR

SEQ ID NO: 7689 - protein, 11 aa, Artificial
  IGFBP-2 heparin binding domain-containing peptide sequence
RRKVGINNPHR

SEQ ID NO: 7690 - protein, 11 aa, Artificial
  IGFBP-2 heparin binding domain-containing peptide sequence
HRKVGINNPHR

SEQ ID NO: 7691 - protein, 11 aa, Artificial
  IGFBP-2 heparin binding domain-containing peptide sequence
KHRVGINNPHR

SEQ ID NO: 7692 - protein, 11 aa, Artificial
  IGFBP-2 heparin binding domain-containing peptide sequence
RHRVGINNPHR

SEQ ID NO: 7693 - protein, 11 aa, Artificial
  IGFBP-2 heparin binding domain-containing peptide sequence
HHRVGINNPHR

SEQ ID NO: 7694 - protein, 11 aa, Artificial
  IGFBP-2 heparin binding domain-containing peptide sequence
KKRVGINNPHR

SEQ ID NO: 7695 - protein, 11 aa, Artificial
  IGFBP-2 heparin binding domain-containing peptide sequence
RKRVGINNPHR

SEQ ID NO: 7696 - protein, 11 aa, Artificial
  IGFBP-2 heparin binding domain-containing peptide sequence
HKRVGINNPHR

SEQ ID NO: 7697 - protein, 11 aa, Artificial
  IGFBP-2 heparin binding domain-containing peptide sequence
KRRVGINNPHR

SEQ ID NO: 7698 - protein, 11 aa, Artificial
  IGFBP-2 heparin binding domain-containing peptide sequence
RRRVGINNPHR

SEQ ID NO: 7699 - protein, 11 aa, Artificial
  IGFBP-2 heparin binding domain-containing peptide sequence
HRRVGINNPHR

SEQ ID NO: 7700 - protein, 11 aa, Artificial
  IGFBP-2 heparin binding domain-containing peptide sequence
KHHLGVNNPHR

SEQ ID NO: 7701 - protein, 11 aa, Artificial
  IGFBP-2 heparin binding domain-containing peptide sequence
RHHLGVNNPHR

SEQ ID NO: 7702 - protein, 11 aa, Artificial
  IGFBP-2 heparin binding domain-containing peptide sequence
HHHLGVNNPHR

SEQ ID NO: 7703 - protein, 11 aa, Artificial
  IGFBP-2 heparin binding domain-containing peptide sequence
KKHLGVNNPHR

SEQ ID NO: 7704 - protein, 11 aa, Artificial
  IGFBP-2 heparin binding domain-containing peptide sequence
RKHLGVNNPHR

SEQ ID NO: 7705 - protein, 11 aa, Artificial
  IGFBP-2 heparin binding domain-containing peptide sequence
HKHLGVNNPHR

SEQ ID NO: 7706 - protein, 11 aa, Artificial
  IGFBP-2 heparin binding domain-containing peptide sequence
KRHLGVNNPHR

SEQ ID NO: 7707 - protein, 11 aa, Artificial
  IGFBP-2 heparin binding domain-containing peptide sequence
RRHLGVNNPHR

SEQ ID NO: 7708 - protein, 11 aa, Artificial
  IGFBP-2 heparin binding domain-containing peptide sequence
HRHLGVNNPHR

SEQ ID NO: 7709 - protein, 11 aa, Artificial
  IGFBP-2 heparin binding domain-containing peptide sequence
KHKLGVNNPHR

SEQ ID NO: 7710 - protein, 11 aa, Artificial
  IGFBP-2 heparin binding domain-containing peptide sequence
RHKLGVNNPHR

SEQ ID NO: 7711 - protein, 11 aa, Artificial
  IGFBP-2 heparin binding domain-containing peptide sequence
HHKLGVNNPHR

SEQ ID NO: 7712 - protein, 11 aa, Artificial
  IGFBP-2 heparin binding domain-containing peptide sequence
KKKLGVNNPHR

SEQ ID NO: 7713 - protein, 11 aa, Artificial
  IGFBP-2 heparin binding domain-containing peptide sequence
RKKLGVNNPHR

SEQ ID NO: 7714 - protein, 11 aa, Artificial
  IGFBP-2 heparin binding domain-containing peptide sequence
HKKLGVNNPHR

SEQ ID NO: 7715 - protein, 11 aa, Artificial
  IGFBP-2 heparin binding domain-containing peptide sequence
KRKLGVNNPHR

SEQ ID NO: 7716 - protein, 11 aa, Artificial
  IGFBP-2 heparin binding domain-containing peptide sequence
RRKLGVNNPHR

SEQ ID NO: 7717 - protein, 11 aa, Artificial
  IGFBP-2 heparin binding domain-containing peptide sequence
HRKLGVNNPHR

SEQ ID NO: 7718 - protein, 11 aa, Artificial
  IGFBP-2 heparin binding domain-containing peptide sequence
KHRLGVNNPHR

SEQ ID NO: 7719 - protein, 11 aa, Artificial
  IGFBP-2 heparin binding domain-containing peptide sequence
RHRLGVNNPHR

SEQ ID NO: 7720 - protein, 11 aa, Artificial
  IGFBP-2 heparin binding domain-containing peptide sequence
HHRLGVNNPHR

SEQ ID NO: 7721 - protein, 11 aa, Artificial
  IGFBP-2 heparin binding domain-containing peptide sequence
KKRLGVNNPHR

SEQ ID NO: 7722 - protein, 11 aa, Artificial
  IGFBP-2 heparin binding domain-containing peptide sequence
RKRLGVNNPHR

SEQ ID NO: 7723 - protein, 11 aa, Artificial
  IGFBP-2 heparin binding domain-containing peptide sequence
HKRLGVNNPHR

SEQ ID NO: 7724 - protein, 11 aa, Artificial
  IGFBP-2 heparin binding domain-containing peptide sequence
KRRLGVNNPHR

SEQ ID NO: 7725 - protein, 11 aa, Artificial
  IGFBP-2 heparin binding domain-containing peptide sequence
RRRLGVNNPHR

SEQ ID NO: 7726 - protein, 11 aa, Artificial
  IGFBP-2 heparin binding domain-containing peptide sequence
HRRLGVNNPHR

SEQ ID NO: 7727 - protein, 11 aa, Artificial
  IGFBP-2 heparin binding domain-containing peptide sequence
KHHIGVNNPHR

SEQ ID NO: 7728 - protein, 11 aa, Artificial
  IGFBP-2 heparin binding domain-containing peptide sequence
RHHIGVNNPHR

SEQ ID NO: 7729 - protein, 11 aa, Artificial
  IGFBP-2 heparin binding domain-containing peptide sequence
HHHIGVNNPHR

SEQ ID NO: 7730 - protein, 11 aa, Artificial
  IGFBP-2 heparin binding domain-containing peptide sequence
KKHIGVNNPHR

SEQ ID NO: 7731 - protein, 11 aa, Artificial
  IGFBP-2 heparin binding domain-containing peptide sequence
RKHIGVNNPHR

SEQ ID NO: 7732 - protein, 11 aa, Artificial
  IGFBP-2 heparin binding domain-containing peptide sequence
HKHIGVNNPHR

SEQ ID NO: 7733 - protein, 11 aa, Artificial
  IGFBP-2 heparin binding domain-containing peptide sequence
KRHIGVNNPHR

SEQ ID NO: 7734 - protein, 11 aa, Artificial
  IGFBP-2 heparin binding domain-containing peptide sequence
RRHIGVNNPHR

SEQ ID NO: 7735 - protein, 11 aa, Artificial
  IGFBP-2 heparin binding domain-containing peptide sequence
HRHIGVNNPHR

SEQ ID NO: 7736 - protein, 11 aa, Artificial
  IGFBP-2 heparin binding domain-containing peptide sequence
KHKIGVNNPHR

SEQ ID NO: 7737 - protein, 11 aa, Artificial
  IGFBP-2 heparin binding domain-containing peptide sequence
RHKIGVNNPHR

SEQ ID NO: 7738 - protein, 11 aa, Artificial
  IGFBP-2 heparin binding domain-containing peptide sequence
HHKIGVNNPHR

SEQ ID NO: 7739 - protein, 11 aa, Artificial
  IGFBP-2 heparin binding domain-containing peptide sequence
KKKIGVNNPHR

SEQ ID NO: 7740 - protein, 11 aa, Artificial
  IGFBP-2 heparin binding domain-containing peptide sequence
RKKIGVNNPHR

SEQ ID NO: 7741 - protein, 11 aa, Artificial
  IGFBP-2 heparin binding domain-containing peptide sequence
HKKIGVNNPHR

SEQ ID NO: 7742 - protein, 11 aa, Artificial
  IGFBP-2 heparin binding domain-containing peptide sequence
KRKIGVNNPHR

SEQ ID NO: 7743 - protein, 11 aa, Artificial
  IGFBP-2 heparin binding domain-containing peptide sequence
RRKIGVNNPHR

SEQ ID NO: 7744 - protein, 11 aa, Artificial
  IGFBP-2 heparin binding domain-containing peptide sequence
HRKIGVNNPHR

SEQ ID NO: 7745 - protein, 11 aa, Artificial
  IGFBP-2 heparin binding domain-containing peptide sequence
KHRIGVNNPHR

SEQ ID NO: 7746 - protein, 11 aa, Artificial
  IGFBP-2 heparin binding domain-containing peptide sequence
RHRIGVNNPHR

SEQ ID NO: 7747 - protein, 11 aa, Artificial
  IGFBP-2 heparin binding domain-containing peptide sequence
HHRIGVNNPHR

SEQ ID NO: 7748 - protein, 11 aa, Artificial
  IGFBP-2 heparin binding domain-containing peptide sequence
KKRIGVNNPHR

SEQ ID NO: 7749 - protein, 11 aa, Artificial
  IGFBP-2 heparin binding domain-containing peptide sequence
RKRIGVNNPHR

SEQ ID NO: 7750 - protein, 11 aa, Artificial
  IGFBP-2 heparin binding domain-containing peptide sequence
HKRIGVNNPHR

SEQ ID NO: 7751 - protein, 11 aa, Artificial
  IGFBP-2 heparin binding domain-containing peptide sequence
KRRIGVNNPHR

SEQ ID NO: 7752 - protein, 11 aa, Artificial
  IGFBP-2 heparin binding domain-containing peptide sequence
RRRIGVNNPHR

SEQ ID NO: 7753 - protein, 11 aa, Artificial
  IGFBP-2 heparin binding domain-containing peptide sequence
HRRIGVNNPHR

SEQ ID NO: 7754 - protein, 11 aa, Artificial
  IGFBP-2 heparin binding domain-containing peptide sequence
KHHVGVNNPHR

SEQ ID NO: 7755 - protein, 11 aa, Artificial
  IGFBP-2 heparin binding domain-containing peptide sequence
RHHVGVNNPHR

SEQ ID NO: 7756 - protein, 11 aa, Artificial
  IGFBP-2 heparin binding domain-containing peptide sequence
HHHVGVNNPHR

SEQ ID NO: 7757 - protein, 11 aa, Artificial
  IGFBP-2 heparin binding domain-containing peptide sequence
KKHVGVNNPHR

SEQ ID NO: 7758 - protein, 11 aa, Artificial
  IGFBP-2 heparin binding domain-containing peptide sequence
RKHVGVNNPHR

SEQ ID NO: 7759 - protein, 11 aa, Artificial
  IGFBP-2 heparin binding domain-containing peptide sequence
HKHVGVNNPHR

SEQ ID NO: 7760 - protein, 11 aa, Artificial
  IGFBP-2 heparin binding domain-containing peptide sequence
KRHVGVNNPHR

SEQ ID NO: 7761 - protein, 11 aa, Artificial
  IGFBP-2 heparin binding domain-containing peptide sequence
RRHVGVNNPHR

SEQ ID NO: 7762 - protein, 11 aa, Artificial
  IGFBP-2 heparin binding domain-containing peptide sequence
HRHVGVNNPHR

SEQ ID NO: 7763 - protein, 11 aa, Artificial
  IGFBP-2 heparin binding domain-containing peptide sequence
KHKVGVNNPHR

SEQ ID NO: 7764 - protein, 11 aa, Artificial
  IGFBP-2 heparin binding domain-containing peptide sequence
RHKVGVNNPHR

SEQ ID NO: 7765 - protein, 11 aa, Artificial
  IGFBP-2 heparin binding domain-containing peptide sequence
HHKVGVNNPHR

SEQ ID NO: 7766 - protein, 11 aa, Artificial
  IGFBP-2 heparin binding domain-containing peptide sequence
KKKVGVNNPHR

SEQ ID NO: 7767 - protein, 11 aa, Artificial
  IGFBP-2 heparin binding domain-containing peptide sequence
RKKVGVNNPHR

SEQ ID NO: 7768 - protein, 11 aa, Artificial
  IGFBP-2 heparin binding domain-containing peptide sequence
HKKVGVNNPHR

SEQ ID NO: 7769 - protein, 11 aa, Artificial
  IGFBP-2 heparin binding domain-containing peptide sequence
KRKVGVNNPHR

SEQ ID NO: 7770 - protein, 11 aa, Artificial
  IGFBP-2 heparin binding domain-containing peptide sequence
RRKVGVNNPHR

SEQ ID NO: 7771 - protein, 11 aa, Artificial
  IGFBP-2 heparin binding domain-containing peptide sequence
HRKVGVNNPHR

SEQ ID NO: 7772 - protein, 11 aa, Artificial
  IGFBP-2 heparin binding domain-containing peptide sequence
KHRVGVNNPHR

SEQ ID NO: 7773 - protein, 11 aa, Artificial
  IGFBP-2 heparin binding domain-containing peptide sequence
RHRVGVNNPHR

SEQ ID NO: 7774 - protein, 11 aa, Artificial
  IGFBP-2 heparin binding domain-containing peptide sequence
HHRVGVNNPHR

SEQ ID NO: 7775 - protein, 11 aa, Artificial
  IGFBP-2 heparin binding domain-containing peptide sequence
KKRVGVNNPHR

SEQ ID NO: 7776 - protein, 11 aa, Artificial
  IGFBP-2 heparin binding domain-containing peptide sequence
RKRVGVNNPHR

SEQ ID NO: 7777 - protein, 11 aa, Artificial
  IGFBP-2 heparin binding domain-containing peptide sequence
HKRVGVNNPHR

SEQ ID NO: 7778 - protein, 11 aa, Artificial
  IGFBP-2 heparin binding domain-containing peptide sequence
KRRVGVNNPHR

SEQ ID NO: 7779 - protein, 11 aa, Artificial
  IGFBP-2 heparin binding domain-containing peptide sequence
RRRVGVNNPHR

SEQ ID NO: 7780 - protein, 11 aa, Artificial
  IGFBP-2 heparin binding domain-containing peptide sequence
HRRVGVNNPHR

SEQ ID NO: 7781 - protein, 11 aa, Artificial
  IGFBP-2 heparin binding domain-containing peptide sequence
KHHLGLEEPHH

SEQ ID NO: 7782 - protein, 11 aa, Artificial
  IGFBP-2 heparin binding domain-containing peptide sequence
RHHLGLEEPHH

SEQ ID NO: 7783 - protein, 11 aa, Artificial
  IGFBP-2 heparin binding domain-containing peptide sequence
HHHLGLEEPHH

SEQ ID NO: 7784 - protein, 11 aa, Artificial
  IGFBP-2 heparin binding domain-containing peptide sequence
KKHLGLEEPHH

SEQ ID NO: 7785 - protein, 11 aa, Artificial
  IGFBP-2 heparin binding domain-containing peptide sequence
RKHLGLEEPHH

SEQ ID NO: 7786 - protein, 11 aa, Artificial
  IGFBP-2 heparin binding domain-containing peptide sequence
HKHLGLEEPHH

SEQ ID NO: 7787 - protein, 11 aa, Artificial
  IGFBP-2 heparin binding domain-containing peptide sequence
KRHLGLEEPHH

SEQ ID NO: 7788 - protein, 11 aa, Artificial
  IGFBP-2 heparin binding domain-containing peptide sequence
RRHLGLEEPHH

SEQ ID NO: 7789 - protein, 11 aa, Artificial
  IGFBP-2 heparin binding domain-containing peptide sequence
HRHLGLEEPHH

SEQ ID NO: 7790 - protein, 11 aa, Artificial
  IGFBP-2 heparin binding domain-containing peptide sequence
KHKLGLEEPHH

SEQ ID NO: 7791 - protein, 11 aa, Artificial
  IGFBP-2 heparin binding domain-containing peptide sequence
RHKLGLEEPHH

SEQ ID NO: 7792 - protein, 11 aa, Artificial
  IGFBP-2 heparin binding domain-containing peptide sequence
HHKLGLEEPHH

SEQ ID NO: 7793 - protein, 11 aa, Artificial
  IGFBP-2 heparin binding domain-containing peptide sequence
KKKLGLEEPHH

SEQ ID NO: 7794 - protein, 11 aa, Artificial
  IGFBP-2 heparin binding domain-containing peptide sequence
RKKLGLEEPHH

SEQ ID NO: 7795 - protein, 11 aa, Artificial
  IGFBP-2 heparin binding domain-containing peptide sequence
HKKLGLEEPHH

SEQ ID NO: 7796 - protein, 11 aa, Artificial
  IGFBP-2 heparin binding domain-containing peptide sequence
KRKLGLEEPHH

SEQ ID NO: 7797 - protein, 11 aa, Artificial
  IGFBP-2 heparin binding domain-containing peptide sequence
RRKLGLEEPHH

SEQ ID NO: 7798 - protein, 11 aa, Artificial
  IGFBP-2 heparin binding domain-containing peptide sequence
HRKLGLEEPHH

SEQ ID NO: 7799 - protein, 11 aa, Artificial
  IGFBP-2 heparin binding domain-containing peptide sequence
KHRLGLEEPHH

SEQ ID NO: 7800 - protein, 11 aa, Artificial
  IGFBP-2 heparin binding domain-containing peptide sequence
RHRLGLEEPHH

SEQ ID NO: 7801 - protein, 11 aa, Artificial
  IGFBP-2 heparin binding domain-containing peptide sequence
HHRLGLEEPHH

SEQ ID NO: 7802 - protein, 11 aa, Artificial
  IGFBP-2 heparin binding domain-containing peptide sequence
KKRLGLEEPHH

SEQ ID NO: 7803 - protein, 11 aa, Artificial
  IGFBP-2 heparin binding domain-containing peptide sequence
RKRLGLEEPHH

SEQ ID NO: 7804 - protein, 11 aa, Artificial
  IGFBP-2 heparin binding domain-containing peptide sequence
HKRLGLEEPHH

SEQ ID NO: 7805 - protein, 11 aa, Artificial
  IGFBP-2 heparin binding domain-containing peptide sequence
KRRLGLEEPHH

SEQ ID NO: 7806 - protein, 11 aa, Artificial
  IGFBP-2 heparin binding domain-containing peptide sequence
RRRLGLEEPHH

SEQ ID NO: 7807 - protein, 11 aa, Artificial
  IGFBP-2 heparin binding domain-containing peptide sequence
HRRLGLEEPHH

SEQ ID NO: 7808 - protein, 11 aa, Artificial
  IGFBP-2 heparin binding domain-containing peptide sequence
KHHIGLEEPHH

SEQ ID NO: 7809 - protein, 11 aa, Artificial
  IGFBP-2 heparin binding domain-containing peptide sequence
RHHIGLEEPHH

SEQ ID NO: 7810 - protein, 11 aa, Artificial
  IGFBP-2 heparin binding domain-containing peptide sequence
HHHIGLEEPHH

SEQ ID NO: 7811 - protein, 11 aa, Artificial
  IGFBP-2 heparin binding domain-containing peptide sequence
KKHIGLEEPHH

SEQ ID NO: 7812 - protein, 11 aa, Artificial
  IGFBP-2 heparin binding domain-containing peptide sequence
RKHIGLEEPHH

SEQ ID NO: 7813 - protein, 11 aa, Artificial
  IGFBP-2 heparin binding domain-containing peptide sequence
HKHIGLEEPHH

SEQ ID NO: 7814 - protein, 11 aa, Artificial
  IGFBP-2 heparin binding domain-containing peptide sequence
KRHIGLEEPHH

SEQ ID NO: 7815 - protein, 11 aa, Artificial
  IGFBP-2 heparin binding domain-containing peptide sequence
RRHIGLEEPHH

SEQ ID NO: 7816 - protein, 11 aa, Artificial
  IGFBP-2 heparin binding domain-containing peptide sequence
HRHIGLEEPHH

SEQ ID NO: 7817 - protein, 11 aa, Artificial
  IGFBP-2 heparin binding domain-containing peptide sequence
KHKIGLEEPHH

SEQ ID NO: 7818 - protein, 11 aa, Artificial
  IGFBP-2 heparin binding domain-containing peptide sequence
RHKIGLEEPHH

SEQ ID NO: 7819 - protein, 11 aa, Artificial
  IGFBP-2 heparin binding domain-containing peptide sequence
HHKIGLEEPHH

SEQ ID NO: 7820 - protein, 11 aa, Artificial
  IGFBP-2 heparin binding domain-containing peptide sequence
KKKIGLEEPHH

SEQ ID NO: 7821 - protein, 11 aa, Artificial
  IGFBP-2 heparin binding domain-containing peptide sequence
RKKIGLEEPHH

SEQ ID NO: 7822 - protein, 11 aa, Artificial
  IGFBP-2 heparin binding domain-containing peptide sequence
HKKIGLEEPHH

SEQ ID NO: 7823 - protein, 11 aa, Artificial
  IGFBP-2 heparin binding domain-containing peptide sequence
KRKIGLEEPHH

SEQ ID NO: 7824 - protein, 11 aa, Artificial
  IGFBP-2 heparin binding domain-containing peptide sequence
RRKIGLEEPHH

SEQ ID NO: 7825 - protein, 11 aa, Artificial
  IGFBP-2 heparin binding domain-containing peptide sequence
HRKIGLEEPHH

SEQ ID NO: 7826 - protein, 11 aa, Artificial
  IGFBP-2 heparin binding domain-containing peptide sequence
KHRIGLEEPHH

SEQ ID NO: 7827 - protein, 11 aa, Artificial
  IGFBP-2 heparin binding domain-containing peptide sequence
RHRIGLEEPHH

SEQ ID NO: 7828 - protein, 11 aa, Artificial
  IGFBP-2 heparin binding domain-containing peptide sequence
HHRIGLEEPHH

SEQ ID NO: 7829 - protein, 11 aa, Artificial
  IGFBP-2 heparin binding domain-containing peptide sequence
KKRIGLEEPHH

SEQ ID NO: 7830 - protein, 11 aa, Artificial
  IGFBP-2 heparin binding domain-containing peptide sequence
RKRIGLEEPHH

SEQ ID NO: 7831 - protein, 11 aa, Artificial
  IGFBP-2 heparin binding domain-containing peptide sequence
HKRIGLEEPHH

SEQ ID NO: 7832 - protein, 11 aa, Artificial
  IGFBP-2 heparin binding domain-containing peptide sequence
KRRIGLEEPHH

SEQ ID NO: 7833 - protein, 11 aa, Artificial
  IGFBP-2 heparin binding domain-containing peptide sequence
RRRIGLEEPHH

SEQ ID NO: 7834 - protein, 11 aa, Artificial
  IGFBP-2 heparin binding domain-containing peptide sequence
HRRIGLEEPHH

SEQ ID NO: 7835 - protein, 11 aa, Artificial
  IGFBP-2 heparin binding domain-containing peptide sequence
KHHVGLEEPHH

SEQ ID NO: 7836 - protein, 11 aa, Artificial
  IGFBP-2 heparin binding domain-containing peptide sequence
RHHVGLEEPHH

SEQ ID NO: 7837 - protein, 11 aa, Artificial
  IGFBP-2 heparin binding domain-containing peptide sequence
HHHVGLEEPHH

SEQ ID NO: 7838 - protein, 11 aa, Artificial
  IGFBP-2 heparin binding domain-containing peptide sequence
KKHVGLEEPHH

SEQ ID NO: 7839 - protein, 11 aa, Artificial
  IGFBP-2 heparin binding domain-containing peptide sequence
RKHVGLEEPHH

SEQ ID NO: 7840 - protein, 11 aa, Artificial
  IGFBP-2 heparin binding domain-containing peptide sequence
HKHVGLEEPHH

SEQ ID NO: 7841 - protein, 11 aa, Artificial
  IGFBP-2 heparin binding domain-containing peptide sequence
KRHVGLEEPHH

SEQ ID NO: 7842 - protein, 11 aa, Artificial
  IGFBP-2 heparin binding domain-containing peptide sequence
RRHVGLEEPHH

SEQ ID NO: 7843 - protein, 11 aa, Artificial
  IGFBP-2 heparin binding domain-containing peptide sequence
HRHVGLEEPHH

SEQ ID NO: 7844 - protein, 11 aa, Artificial
  IGFBP-2 heparin binding domain-containing peptide sequence
KHKVGLEEPHH

SEQ ID NO: 7845 - protein, 11 aa, Artificial
  IGFBP-2 heparin binding domain-containing peptide sequence
RHKVGLEEPHH

SEQ ID NO: 7846 - protein, 11 aa, Artificial
  IGFBP-2 heparin binding domain-containing peptide sequence
HHKVGLEEPHH

SEQ ID NO: 7847 - protein, 11 aa, Artificial
  IGFBP-2 heparin binding domain-containing peptide sequence
KKKVGLEEPHH

SEQ ID NO: 7848 - protein, 11 aa, Artificial
  IGFBP-2 heparin binding domain-containing peptide sequence
RKKVGLEEPHH

SEQ ID NO: 7849 - protein, 11 aa, Artificial
  IGFBP-2 heparin binding domain-containing peptide sequence
HKKVGLEEPHH

SEQ ID NO: 7850 - protein, 11 aa, Artificial
  IGFBP-2 heparin binding domain-containing peptide sequence
KRKVGLEEPHH

SEQ ID NO: 7851 - protein, 11 aa, Artificial
  IGFBP-2 heparin binding domain-containing peptide sequence
RRKVGLEEPHH

SEQ ID NO: 7852 - protein, 11 aa, Artificial
  IGFBP-2 heparin binding domain-containing peptide sequence
HRKVGLEEPHH

SEQ ID NO: 7853 - protein, 11 aa, Artificial
  IGFBP-2 heparin binding domain-containing peptide sequence
KHRVGLEEPHH

SEQ ID NO: 7854 - protein, 11 aa, Artificial
  IGFBP-2 heparin binding domain-containing peptide sequence
RHRVGLEEPHH

SEQ ID NO: 7855 - protein, 11 aa, Artificial
  IGFBP-2 heparin binding domain-containing peptide sequence
HHRVGLEEPHH

SEQ ID NO: 7856 - protein, 11 aa, Artificial
  IGFBP-2 heparin binding domain-containing peptide sequence
KKRVGLEEPHH

SEQ ID NO: 7857 - protein, 11 aa, Artificial
  IGFBP-2 heparin binding domain-containing peptide sequence
RKRVGLEEPHH

SEQ ID NO: 7858 - protein, 11 aa, Artificial
  IGFBP-2 heparin binding domain-containing peptide sequence
HKRVGLEEPHH

SEQ ID NO: 7859 - protein, 11 aa, Artificial
  IGFBP-2 heparin binding domain-containing peptide sequence
KRRVGLEEPHH

SEQ ID NO: 7860 - protein, 11 aa, Artificial
  IGFBP-2 heparin binding domain-containing peptide sequence
RRRVGLEEPHH

SEQ ID NO: 7861 - protein, 11 aa, Artificial
  IGFBP-2 heparin binding domain-containing peptide sequence
HRRVGLEEPHH

SEQ ID NO: 7862 - protein, 11 aa, Artificial
  IGFBP-2 heparin binding domain-containing peptide sequence
KHHLGIEEPHH

SEQ ID NO: 7863 - protein, 11 aa, Artificial
  IGFBP-2 heparin binding domain-containing peptide sequence
RHHLGIEEPHH

SEQ ID NO: 7864 - protein, 11 aa, Artificial
  IGFBP-2 heparin binding domain-containing peptide sequence
HHHLGIEEPHH

SEQ ID NO: 7865 - protein, 11 aa, Artificial
  IGFBP-2 heparin binding domain-containing peptide sequence
KKHLGIEEPHH

SEQ ID NO: 7866 - protein, 11 aa, Artificial
  IGFBP-2 heparin binding domain-containing peptide sequence
RKHLGIEEPHH

SEQ ID NO: 7867 - protein, 11 aa, Artificial
  IGFBP-2 heparin binding domain-containing peptide sequence
HKHLGIEEPHH

SEQ ID NO: 7868 - protein, 11 aa, Artificial
  IGFBP-2 heparin binding domain-containing peptide sequence
KRHLGIEEPHH

SEQ ID NO: 7869 - protein, 11 aa, Artificial
  IGFBP-2 heparin binding domain-containing peptide sequence
RRHLGIEEPHH

SEQ ID NO: 7870 - protein, 11 aa, Artificial
  IGFBP-2 heparin binding domain-containing peptide sequence
HRHLGIEEPHH

SEQ ID NO: 7871 - protein, 11 aa, Artificial
  IGFBP-2 heparin binding domain-containing peptide sequence
KHKLGIEEPHH

SEQ ID NO: 7872 - protein, 11 aa, Artificial
  IGFBP-2 heparin binding domain-containing peptide sequence
RHKLGIEEPHH

SEQ ID NO: 7873 - protein, 11 aa, Artificial
  IGFBP-2 heparin binding domain-containing peptide sequence
HHKLGIEEPHH

SEQ ID NO: 7874 - protein, 11 aa, Artificial
  IGFBP-2 heparin binding domain-containing peptide sequence
KKKLGIEEPHH

SEQ ID NO: 7875 - protein, 11 aa, Artificial
  IGFBP-2 heparin binding domain-containing peptide sequence
RKKLGIEEPHH

SEQ ID NO: 7876 - protein, 11 aa, Artificial
  IGFBP-2 heparin binding domain-containing peptide sequence
HKKLGIEEPHH

SEQ ID NO: 7877 - protein, 11 aa, Artificial
  IGFBP-2 heparin binding domain-containing peptide sequence
KRKLGIEEPHH

SEQ ID NO: 7878 - protein, 11 aa, Artificial
  IGFBP-2 heparin binding domain-containing peptide sequence
RRKLGIEEPHH

SEQ ID NO: 7879 - protein, 11 aa, Artificial
  IGFBP-2 heparin binding domain-containing peptide sequence
HRKLGIEEPHH

SEQ ID NO: 7880 - protein, 11 aa, Artificial
  IGFBP-2 heparin binding domain-containing peptide sequence
KHRLGIEEPHH

SEQ ID NO: 7881 - protein, 11 aa, Artificial
  IGFBP-2 heparin binding domain-containing peptide sequence
RHRLGIEEPHH

SEQ ID NO: 7882 - protein, 11 aa, Artificial
  IGFBP-2 heparin binding domain-containing peptide sequence
HHRLGIEEPHH

SEQ ID NO: 7883 - protein, 11 aa, Artificial
  IGFBP-2 heparin binding domain-containing peptide sequence
KKRLGIEEPHH

SEQ ID NO: 7884 - protein, 11 aa, Artificial
  IGFBP-2 heparin binding domain-containing peptide sequence
RKRLGIEEPHH

SEQ ID NO: 7885 - protein, 11 aa, Artificial
  IGFBP-2 heparin binding domain-containing peptide sequence
HKRLGIEEPHH

SEQ ID NO: 7886 - protein, 11 aa, Artificial
  IGFBP-2 heparin binding domain-containing peptide sequence
KRRLGIEEPHH

SEQ ID NO: 7887 - protein, 11 aa, Artificial
  IGFBP-2 heparin binding domain-containing peptide sequence
RRRLGIEEPHH

SEQ ID NO: 7888 - protein, 11 aa, Artificial
  IGFBP-2 heparin binding domain-containing peptide sequence
HRRLGIEEPHH

SEQ ID NO: 7889 - protein, 11 aa, Artificial
  IGFBP-2 heparin binding domain-containing peptide sequence
KHHIGIEEPHH

SEQ ID NO: 7890 - protein, 11 aa, Artificial
  IGFBP-2 heparin binding domain-containing peptide sequence
RHHIGIEEPHH

SEQ ID NO: 7891 - protein, 11 aa, Artificial
  IGFBP-2 heparin binding domain-containing peptide sequence
HHHIGIEEPHH

SEQ ID NO: 7892 - protein, 11 aa, Artificial
  IGFBP-2 heparin binding domain-containing peptide sequence
KKHIGIEEPHH

SEQ ID NO: 7893 - protein, 11 aa, Artificial
  IGFBP-2 heparin binding domain-containing peptide sequence
RKHIGIEEPHH

SEQ ID NO: 7894 - protein, 11 aa, Artificial
  IGFBP-2 heparin binding domain-containing peptide sequence
HKHIGIEEPHH

SEQ ID NO: 7895 - protein, 11 aa, Artificial
  IGFBP-2 heparin binding domain-containing peptide sequence
KRHIGIEEPHH

SEQ ID NO: 7896 - protein, 11 aa, Artificial
  IGFBP-2 heparin binding domain-containing peptide sequence
RRHIGIEEPHH

SEQ ID NO: 7897 - protein, 11 aa, Artificial
  IGFBP-2 heparin binding domain-containing peptide sequence
HRHIGIEEPHH

SEQ ID NO: 7898 - protein, 11 aa, Artificial
  IGFBP-2 heparin binding domain-containing peptide sequence
KHKIGIEEPHH

SEQ ID NO: 7899 - protein, 11 aa, Artificial
  IGFBP-2 heparin binding domain-containing peptide sequence
RHKIGIEEPHH

SEQ ID NO: 7900 - protein, 11 aa, Artificial
  IGFBP-2 heparin binding domain-containing peptide sequence
HHKIGIEEPHH

SEQ ID NO: 7901 - protein, 11 aa, Artificial
  IGFBP-2 heparin binding domain-containing peptide sequence
KKKIGIEEPHH

SEQ ID NO: 7902 - protein, 11 aa, Artificial
  IGFBP-2 heparin binding domain-containing peptide sequence
RKKIGIEEPHH

SEQ ID NO: 7903 - protein, 11 aa, Artificial
  IGFBP-2 heparin binding domain-containing peptide sequence
HKKIGIEEPHH

SEQ ID NO: 7904 - protein, 11 aa, Artificial
  IGFBP-2 heparin binding domain-containing peptide sequence
KRKIGIEEPHH

SEQ ID NO: 7905 - protein, 11 aa, Artificial
  IGFBP-2 heparin binding domain-containing peptide sequence
RRKIGIEEPHH

SEQ ID NO: 7906 - protein, 11 aa, Artificial
  IGFBP-2 heparin binding domain-containing peptide sequence
HRKIGIEEPHH

SEQ ID NO: 7907 - protein, 11 aa, Artificial
  IGFBP-2 heparin binding domain-containing peptide sequence
KHRIGIEEPHH

SEQ ID NO: 7908 - protein, 11 aa, Artificial
  IGFBP-2 heparin binding domain-containing peptide sequence
RHRIGIEEPHH

SEQ ID NO: 7909 - protein, 11 aa, Artificial
  IGFBP-2 heparin binding domain-containing peptide sequence
HHRIGIEEPHH

SEQ ID NO: 7910 - protein, 11 aa, Artificial
  IGFBP-2 heparin binding domain-containing peptide sequence
KKRIGIEEPHH

SEQ ID NO: 7911 - protein, 11 aa, Artificial
  IGFBP-2 heparin binding domain-containing peptide sequence
RKRIGIEEPHH

SEQ ID NO: 7912 - protein, 11 aa, Artificial
  IGFBP-2 heparin binding domain-containing peptide sequence
HKRIGIEEPHH

SEQ ID NO: 7913 - protein, 11 aa, Artificial
  IGFBP-2 heparin binding domain-containing peptide sequence
KRRIGIEEPHH

SEQ ID NO: 7914 - protein, 11 aa, Artificial
  IGFBP-2 heparin binding domain-containing peptide sequence
RRRIGIEEPHH

SEQ ID NO: 7915 - protein, 11 aa, Artificial
  IGFBP-2 heparin binding domain-containing peptide sequence
HRRIGIEEPHH

SEQ ID NO: 7916 - protein, 11 aa, Artificial
  IGFBP-2 heparin binding domain-containing peptide sequence
KHHVGIEEPHH

SEQ ID NO: 7917 - protein, 11 aa, Artificial
  IGFBP-2 heparin binding domain-containing peptide sequence
RHHVGIEEPHH

SEQ ID NO: 7918 - protein, 11 aa, Artificial
  IGFBP-2 heparin binding domain-containing peptide sequence
HHHVGIEEPHH

SEQ ID NO: 7919 - protein, 11 aa, Artificial
  IGFBP-2 heparin binding domain-containing peptide sequence
KKHVGIEEPHH

SEQ ID NO: 7920 - protein, 11 aa, Artificial
  IGFBP-2 heparin binding domain-containing peptide sequence
RKHVGIEEPHH

SEQ ID NO: 7921 - protein, 11 aa, Artificial
  IGFBP-2 heparin binding domain-containing peptide sequence
HKHVGIEEPHH

SEQ ID NO: 7922 - protein, 11 aa, Artificial
  IGFBP-2 heparin binding domain-containing peptide sequence
KRHVGIEEPHH

SEQ ID NO: 7923 - protein, 11 aa, Artificial
  IGFBP-2 heparin binding domain-containing peptide sequence
RRHVGIEEPHH

SEQ ID NO: 7924 - protein, 11 aa, Artificial
  IGFBP-2 heparin binding domain-containing peptide sequence
HRHVGIEEPHH

SEQ ID NO: 7925 - protein, 11 aa, Artificial
  IGFBP-2 heparin binding domain-containing peptide sequence
KHKVGIEEPHH

SEQ ID NO: 7926 - protein, 11 aa, Artificial
  IGFBP-2 heparin binding domain-containing peptide sequence
RHKVGIEEPHH

SEQ ID NO: 7927 - protein, 11 aa, Artificial
  IGFBP-2 heparin binding domain-containing peptide sequence
HHKVGIEEPHH

SEQ ID NO: 7928 - protein, 11 aa, Artificial
  IGFBP-2 heparin binding domain-containing peptide sequence
KKKVGIEEPHH

SEQ ID NO: 7929 - protein, 11 aa, Artificial
  IGFBP-2 heparin binding domain-containing peptide sequence
RKKVGIEEPHH

SEQ ID NO: 7930 - protein, 11 aa, Artificial
  IGFBP-2 heparin binding domain-containing peptide sequence
HKKVGIEEPHH

SEQ ID NO: 7931 - protein, 11 aa, Artificial
  IGFBP-2 heparin binding domain-containing peptide sequence
KRKVGIEEPHH

SEQ ID NO: 7932 - protein, 11 aa, Artificial
  IGFBP-2 heparin binding domain-containing peptide sequence
RRKVGIEEPHH

SEQ ID NO: 7933 - protein, 11 aa, Artificial
  IGFBP-2 heparin binding domain-containing peptide sequence
HRKVGIEEPHH

SEQ ID NO: 7934 - protein, 11 aa, Artificial
  IGFBP-2 heparin binding domain-containing peptide sequence
KHRVGIEEPHH

SEQ ID NO: 7935 - protein, 11 aa, Artificial
  IGFBP-2 heparin binding domain-containing peptide sequence
RHRVGIEEPHH

SEQ ID NO: 7936 - protein, 11 aa, Artificial
  IGFBP-2 heparin binding domain-containing peptide sequence
HHRVGIEEPHH

SEQ ID NO: 7937 - protein, 11 aa, Artificial
  IGFBP-2 heparin binding domain-containing peptide sequence
KKRVGIEEPHH

SEQ ID NO: 7938 - protein, 11 aa, Artificial
  IGFBP-2 heparin binding domain-containing peptide sequence
RKRVGIEEPHH

SEQ ID NO: 7939 - protein, 11 aa, Artificial
  IGFBP-2 heparin binding domain-containing peptide sequence
HKRVGIEEPHH

SEQ ID NO: 7940 - protein, 11 aa, Artificial
  IGFBP-2 heparin binding domain-containing peptide sequence
KRRVGIEEPHH

SEQ ID NO: 7941 - protein, 11 aa, Artificial
  IGFBP-2 heparin binding domain-containing peptide sequence
RRRVGIEEPHH

SEQ ID NO: 7942 - protein, 11 aa, Artificial
  IGFBP-2 heparin binding domain-containing peptide sequence
HRRVGIEEPHH

SEQ ID NO: 7943 - protein, 11 aa, Artificial
  IGFBP-2 heparin binding domain-containing peptide sequence
KHHLGVEEPHH

SEQ ID NO: 7944 - protein, 11 aa, Artificial
  IGFBP-2 heparin binding domain-containing peptide sequence
RHHLGVEEPHH

SEQ ID NO: 7945 - protein, 11 aa, Artificial
  IGFBP-2 heparin binding domain-containing peptide sequence
HHHLGVEEPHH

SEQ ID NO: 7946 - protein, 11 aa, Artificial
  IGFBP-2 heparin binding domain-containing peptide sequence
KKHLGVEEPHH

SEQ ID NO: 7947 - protein, 11 aa, Artificial
  IGFBP-2 heparin binding domain-containing peptide sequence
RKHLGVEEPHH

SEQ ID NO: 7948 - protein, 11 aa, Artificial
  IGFBP-2 heparin binding domain-containing peptide sequence
HKHLGVEEPHH

SEQ ID NO: 7949 - protein, 11 aa, Artificial
  IGFBP-2 heparin binding domain-containing peptide sequence
KRHLGVEEPHH

SEQ ID NO: 7950 - protein, 11 aa, Artificial
  IGFBP-2 heparin binding domain-containing peptide sequence
RRHLGVEEPHH

SEQ ID NO: 7951 - protein, 11 aa, Artificial
  IGFBP-2 heparin binding domain-containing peptide sequence
HRHLGVEEPHH

SEQ ID NO: 7952 - protein, 11 aa, Artificial
  IGFBP-2 heparin binding domain-containing peptide sequence
KHKLGVEEPHH

SEQ ID NO: 7953 - protein, 11 aa, Artificial
  IGFBP-2 heparin binding domain-containing peptide sequence
RHKLGVEEPHH

SEQ ID NO: 7954 - protein, 11 aa, Artificial
  IGFBP-2 heparin binding domain-containing peptide sequence
HHKLGVEEPHH

SEQ ID NO: 7955 - protein, 11 aa, Artificial
  IGFBP-2 heparin binding domain-containing peptide sequence
KKKLGVEEPHH

SEQ ID NO: 7956 - protein, 11 aa, Artificial
  IGFBP-2 heparin binding domain-containing peptide sequence
RKKLGVEEPHH

SEQ ID NO: 7957 - protein, 11 aa, Artificial
  IGFBP-2 heparin binding domain-containing peptide sequence
HKKLGVEEPHH

SEQ ID NO: 7958 - protein, 11 aa, Artificial
  IGFBP-2 heparin binding domain-containing peptide sequence
KRKLGVEEPHH

SEQ ID NO: 7959 - protein, 11 aa, Artificial
  IGFBP-2 heparin binding domain-containing peptide sequence
RRKLGVEEPHH

SEQ ID NO: 7960 - protein, 11 aa, Artificial
  IGFBP-2 heparin binding domain-containing peptide sequence
HRKLGVEEPHH

SEQ ID NO: 7961 - protein, 11 aa, Artificial
  IGFBP-2 heparin binding domain-containing peptide sequence
KHRLGVEEPHH

SEQ ID NO: 7962 - protein, 11 aa, Artificial
  IGFBP-2 heparin binding domain-containing peptide sequence
RHRLGVEEPHH

SEQ ID NO: 7963 - protein, 11 aa, Artificial
  IGFBP-2 heparin binding domain-containing peptide sequence
HHRLGVEEPHH

SEQ ID NO: 7964 - protein, 11 aa, Artificial
  IGFBP-2 heparin binding domain-containing peptide sequence
KKRLGVEEPHH

SEQ ID NO: 7965 - protein, 11 aa, Artificial
  IGFBP-2 heparin binding domain-containing peptide sequence
RKRLGVEEPHH

SEQ ID NO: 7966 - protein, 11 aa, Artificial
  IGFBP-2 heparin binding domain-containing peptide sequence
HKRLGVEEPHH

SEQ ID NO: 7967 - protein, 11 aa, Artificial
  IGFBP-2 heparin binding domain-containing peptide sequence
KRRLGVEEPHH

SEQ ID NO: 7968 - protein, 11 aa, Artificial
  IGFBP-2 heparin binding domain-containing peptide sequence
RRRLGVEEPHH

SEQ ID NO: 7969 - protein, 11 aa, Artificial
  IGFBP-2 heparin binding domain-containing peptide sequence
HRRLGVEEPHH

SEQ ID NO: 7970 - protein, 11 aa, Artificial
  IGFBP-2 heparin binding domain-containing peptide sequence
KHHIGVEEPHH

SEQ ID NO: 7971 - protein, 11 aa, Artificial
  IGFBP-2 heparin binding domain-containing peptide sequence
RHHIGVEEPHH

SEQ ID NO: 7972 - protein, 11 aa, Artificial
  IGFBP-2 heparin binding domain-containing peptide sequence
HHHIGVEEPHH

SEQ ID NO: 7973 - protein, 11 aa, Artificial
  IGFBP-2 heparin binding domain-containing peptide sequence
KKHIGVEEPHH

SEQ ID NO: 7974 - protein, 11 aa, Artificial
  IGFBP-2 heparin binding domain-containing peptide sequence
RKHIGVEEPHH

SEQ ID NO: 7975 - protein, 11 aa, Artificial
  IGFBP-2 heparin binding domain-containing peptide sequence
HKHIGVEEPHH

SEQ ID NO: 7976 - protein, 11 aa, Artificial
  IGFBP-2 heparin binding domain-containing peptide sequence
KRHIGVEEPHH

SEQ ID NO: 7977 - protein, 11 aa, Artificial
  IGFBP-2 heparin binding domain-containing peptide sequence
RRHIGVEEPHH

SEQ ID NO: 7978 - protein, 11 aa, Artificial
  IGFBP-2 heparin binding domain-containing peptide sequence
HRHIGVEEPHH

SEQ ID NO: 7979 - protein, 11 aa, Artificial
  IGFBP-2 heparin binding domain-containing peptide sequence
KHKIGVEEPHH

SEQ ID NO: 7980 - protein, 11 aa, Artificial
  IGFBP-2 heparin binding domain-containing peptide sequence
RHKIGVEEPHH

SEQ ID NO: 7981 - protein, 11 aa, Artificial
  IGFBP-2 heparin binding domain-containing peptide sequence
HHKIGVEEPHH

SEQ ID NO: 7982 - protein, 11 aa, Artificial
  IGFBP-2 heparin binding domain-containing peptide sequence
KKKIGVEEPHH

SEQ ID NO: 7983 - protein, 11 aa, Artificial
  IGFBP-2 heparin binding domain-containing peptide sequence
RKKIGVEEPHH

SEQ ID NO: 7984 - protein, 11 aa, Artificial
  IGFBP-2 heparin binding domain-containing peptide sequence
HKKIGVEEPHH

SEQ ID NO: 7985 - protein, 11 aa, Artificial
  IGFBP-2 heparin binding domain-containing peptide sequence
KRKIGVEEPHH

SEQ ID NO: 7986 - protein, 11 aa, Artificial
  IGFBP-2 heparin binding domain-containing peptide sequence
RRKIGVEEPHH

SEQ ID NO: 7987 - protein, 11 aa, Artificial
  IGFBP-2 heparin binding domain-containing peptide sequence
HRKIGVEEPHH

SEQ ID NO: 7988 - protein, 11 aa, Artificial
  IGFBP-2 heparin binding domain-containing peptide sequence
KHRIGVEEPHH

SEQ ID NO: 7989 - protein, 11 aa, Artificial
  IGFBP-2 heparin binding domain-containing peptide sequence
RHRIGVEEPHH

SEQ ID NO: 7990 - protein, 11 aa, Artificial
  IGFBP-2 heparin binding domain-containing peptide sequence
HHRIGVEEPHH

SEQ ID NO: 7991 - protein, 11 aa, Artificial
  IGFBP-2 heparin binding domain-containing peptide sequence
KKRIGVEEPHH

SEQ ID NO: 7992 - protein, 11 aa, Artificial
  IGFBP-2 heparin binding domain-containing peptide sequence
RKRIGVEEPHH

SEQ ID NO: 7993 - protein, 11 aa, Artificial
  IGFBP-2 heparin binding domain-containing peptide sequence
HKRIGVEEPHH

SEQ ID NO: 7994 - protein, 11 aa, Artificial
  IGFBP-2 heparin binding domain-containing peptide sequence
KRRIGVEEPHH

SEQ ID NO: 7995 - protein, 11 aa, Artificial
  IGFBP-2 heparin binding domain-containing peptide sequence
RRRIGVEEPHH

SEQ ID NO: 7996 - protein, 11 aa, Artificial
  IGFBP-2 heparin binding domain-containing peptide sequence
HRRIGVEEPHH

SEQ ID NO: 7997 - protein, 11 aa, Artificial
  IGFBP-2 heparin binding domain-containing peptide sequence
KHHVGVEEPHH

SEQ ID NO: 7998 - protein, 11 aa, Artificial
  IGFBP-2 heparin binding domain-containing peptide sequence
RHHVGVEEPHH

SEQ ID NO: 7999 - protein, 11 aa, Artificial
  IGFBP-2 heparin binding domain-containing peptide sequence
HHHVGVEEPHH

SEQ ID NO: 8000 - protein, 11 aa, Artificial
  IGFBP-2 heparin binding domain-containing peptide sequence
KKHVGVEEPHH

SEQ ID NO: 8001 - protein, 11 aa, Artificial
  IGFBP-2 heparin binding domain-containing peptide sequence
RKHVGVEEPHH

SEQ ID NO: 8002 - protein, 11 aa, Artificial
  IGFBP-2 heparin binding domain-containing peptide sequence
HKHVGVEEPHH

SEQ ID NO: 8003 - protein, 11 aa, Artificial
  IGFBP-2 heparin binding domain-containing peptide sequence
KRHVGVEEPHH

SEQ ID NO: 8004 - protein, 11 aa, Artificial
  IGFBP-2 heparin binding domain-containing peptide sequence
RRHVGVEEPHH

SEQ ID NO: 8005 - protein, 11 aa, Artificial
  IGFBP-2 heparin binding domain-containing peptide sequence
HRHVGVEEPHH

SEQ ID NO: 8006 - protein, 11 aa, Artificial
  IGFBP-2 heparin binding domain-containing peptide sequence
KHKVGVEEPHH

SEQ ID NO: 8007 - protein, 11 aa, Artificial
  IGFBP-2 heparin binding domain-containing peptide sequence
RHKVGVEEPHH

SEQ ID NO: 8008 - protein, 11 aa, Artificial
  IGFBP-2 heparin binding domain-containing peptide sequence
HHKVGVEEPHH

SEQ ID NO: 8009 - protein, 11 aa, Artificial
  IGFBP-2 heparin binding domain-containing peptide sequence
KKKVGVEEPHH

SEQ ID NO: 8010 - protein, 11 aa, Artificial
  IGFBP-2 heparin binding domain-containing peptide sequence
RKKVGVEEPHH

SEQ ID NO: 8011 - protein, 11 aa, Artificial
  IGFBP-2 heparin binding domain-containing peptide sequence
HKKVGVEEPHH

SEQ ID NO: 8012 - protein, 11 aa, Artificial
  IGFBP-2 heparin binding domain-containing peptide sequence
KRKVGVEEPHH

SEQ ID NO: 8013 - protein, 11 aa, Artificial
  IGFBP-2 heparin binding domain-containing peptide sequence
RRKVGVEEPHH

SEQ ID NO: 8014 - protein, 11 aa, Artificial
  IGFBP-2 heparin binding domain-containing peptide sequence
HRKVGVEEPHH

SEQ ID NO: 8015 - protein, 11 aa, Artificial
  IGFBP-2 heparin binding domain-containing peptide sequence
KHRVGVEEPHH

SEQ ID NO: 8016 - protein, 11 aa, Artificial
  IGFBP-2 heparin binding domain-containing peptide sequence
RHRVGVEEPHH

SEQ ID NO: 8017 - protein, 11 aa, Artificial
  IGFBP-2 heparin binding domain-containing peptide sequence
HHRVGVEEPHH

SEQ ID NO: 8018 - protein, 11 aa, Artificial
  IGFBP-2 heparin binding domain-containing peptide sequence
KKRVGVEEPHH

SEQ ID NO: 8019 - protein, 11 aa, Artificial
  IGFBP-2 heparin binding domain-containing peptide sequence
RKRVGVEEPHH

SEQ ID NO: 8020 - protein, 11 aa, Artificial
  IGFBP-2 heparin binding domain-containing peptide sequence
HKRVGVEEPHH

SEQ ID NO: 8021 - protein, 11 aa, Artificial
  IGFBP-2 heparin binding domain-containing peptide sequence
KRRVGVEEPHH

SEQ ID NO: 8022 - protein, 11 aa, Artificial
  IGFBP-2 heparin binding domain-containing peptide sequence
RRRVGVEEPHH

SEQ ID NO: 8023 - protein, 11 aa, Artificial
  IGFBP-2 heparin binding domain-containing peptide sequence
HRRVGVEEPHH

SEQ ID NO: 8024 - protein, 11 aa, Artificial
  IGFBP-2 heparin binding domain-containing peptide sequence
KHHLGLNEPHH

SEQ ID NO: 8025 - protein, 11 aa, Artificial
  IGFBP-2 heparin binding domain-containing peptide sequence
RHHLGLNEPHH

SEQ ID NO: 8026 - protein, 11 aa, Artificial
  IGFBP-2 heparin binding domain-containing peptide sequence
HHHLGLNEPHH

SEQ ID NO: 8027 - protein, 11 aa, Artificial
  IGFBP-2 heparin binding domain-containing peptide sequence
KKHLGLNEPHH

SEQ ID NO: 8028 - protein, 11 aa, Artificial
  IGFBP-2 heparin binding domain-containing peptide sequence
RKHLGLNEPHH

SEQ ID NO: 8029 - protein, 11 aa, Artificial
  IGFBP-2 heparin binding domain-containing peptide sequence
HKHLGLNEPHH

SEQ ID NO: 8030 - protein, 11 aa, Artificial
  IGFBP-2 heparin binding domain-containing peptide sequence
KRHLGLNEPHH

SEQ ID NO: 8031 - protein, 11 aa, Artificial
  IGFBP-2 heparin binding domain-containing peptide sequence
RRHLGLNEPHH

SEQ ID NO: 8032 - protein, 11 aa, Artificial
  IGFBP-2 heparin binding domain-containing peptide sequence
HRHLGLNEPHH

SEQ ID NO: 8033 - protein, 11 aa, Artificial
  IGFBP-2 heparin binding domain-containing peptide sequence
KHKLGLNEPHH

SEQ ID NO: 8034 - protein, 11 aa, Artificial
  IGFBP-2 heparin binding domain-containing peptide sequence
RHKLGLNEPHH

SEQ ID NO: 8035 - protein, 11 aa, Artificial
  IGFBP-2 heparin binding domain-containing peptide sequence
HHKLGLNEPHH

SEQ ID NO: 8036 - protein, 11 aa, Artificial
  IGFBP-2 heparin binding domain-containing peptide sequence
KKKLGLNEPHH

SEQ ID NO: 8037 - protein, 11 aa, Artificial
  IGFBP-2 heparin binding domain-containing peptide sequence
RKKLGLNEPHH

SEQ ID NO: 8038 - protein, 11 aa, Artificial
  IGFBP-2 heparin binding domain-containing peptide sequence
HKKLGLNEPHH

SEQ ID NO: 8039 - protein, 11 aa, Artificial
  IGFBP-2 heparin binding domain-containing peptide sequence
KRKLGLNEPHH

SEQ ID NO: 8040 - protein, 11 aa, Artificial
  IGFBP-2 heparin binding domain-containing peptide sequence
RRKLGLNEPHH

SEQ ID NO: 8041 - protein, 11 aa, Artificial
  IGFBP-2 heparin binding domain-containing peptide sequence
HRKLGLNEPHH

SEQ ID NO: 8042 - protein, 11 aa, Artificial
  IGFBP-2 heparin binding domain-containing peptide sequence
KHRLGLNEPHH

SEQ ID NO: 8043 - protein, 11 aa, Artificial
  IGFBP-2 heparin binding domain-containing peptide sequence
RHRLGLNEPHH

SEQ ID NO: 8044 - protein, 11 aa, Artificial
  IGFBP-2 heparin binding domain-containing peptide sequence
HHRLGLNEPHH

SEQ ID NO: 8045 - protein, 11 aa, Artificial
  IGFBP-2 heparin binding domain-containing peptide sequence
KKRLGLNEPHH

SEQ ID NO: 8046 - protein, 11 aa, Artificial
  IGFBP-2 heparin binding domain-containing peptide sequence
RKRLGLNEPHH

SEQ ID NO: 8047 - protein, 11 aa, Artificial
  IGFBP-2 heparin binding domain-containing peptide sequence
HKRLGLNEPHH

SEQ ID NO: 8048 - protein, 11 aa, Artificial
  IGFBP-2 heparin binding domain-containing peptide sequence
KRRLGLNEPHH

SEQ ID NO: 8049 - protein, 11 aa, Artificial
  IGFBP-2 heparin binding domain-containing peptide sequence
RRRLGLNEPHH

SEQ ID NO: 8050 - protein, 11 aa, Artificial
  IGFBP-2 heparin binding domain-containing peptide sequence
HRRLGLNEPHH

SEQ ID NO: 8051 - protein, 10 aa, Artificial
  IGFBP-2 heparin binding domain-containing peptide sequence
KHHIGLNPHH

SEQ ID NO: 8052 - protein, 11 aa, Artificial
  IGFBP-2 heparin binding domain-containing peptide sequence
RHHIGLNEPHH

SEQ ID NO: 8053 - protein, 11 aa, Artificial
  IGFBP-2 heparin binding domain-containing peptide sequence
HHHIGLNEPHH

SEQ ID NO: 8054 - protein, 11 aa, Artificial
  IGFBP-2 heparin binding domain-containing peptide sequence
KKHIGLNEPHH

SEQ ID NO: 8055 - protein, 11 aa, Artificial
  IGFBP-2 heparin binding domain-containing peptide sequence
RKHIGLNEPHH

SEQ ID NO: 8056 - protein, 11 aa, Artificial
  IGFBP-2 heparin binding domain-containing peptide sequence
HKHIGLNEPHH

SEQ ID NO: 8057 - protein, 11 aa, Artificial
  IGFBP-2 heparin binding domain-containing peptide sequence
KRHIGLNEPHH

SEQ ID NO: 8058 - protein, 11 aa, Artificial
  IGFBP-2 heparin binding domain-containing peptide sequence
RRHIGLNEPHH

SEQ ID NO: 8059 - protein, 11 aa, Artificial
  IGFBP-2 heparin binding domain-containing peptide sequence
HRHIGLNEPHH

SEQ ID NO: 8060 - protein, 11 aa, Artificial
  IGFBP-2 heparin binding domain-containing peptide sequence
KHKIGLNEPHH

SEQ ID NO: 8061 - protein, 11 aa, Artificial
  IGFBP-2 heparin binding domain-containing peptide sequence
RHKIGLNEPHH

SEQ ID NO: 8062 - protein, 11 aa, Artificial
  IGFBP-2 heparin binding domain-containing peptide sequence
HHKIGLNEPHH

SEQ ID NO: 8063 - protein, 11 aa, Artificial
  IGFBP-2 heparin binding domain-containing peptide sequence
KKKIGLNEPHH

SEQ ID NO: 8064 - protein, 11 aa, Artificial
  IGFBP-2 heparin binding domain-containing peptide sequence
RKKIGLNEPHH

SEQ ID NO: 8065 - protein, 11 aa, Artificial
  IGFBP-2 heparin binding domain-containing peptide sequence
HKKIGLNEPHH

SEQ ID NO: 8066 - protein, 11 aa, Artificial
  IGFBP-2 heparin binding domain-containing peptide sequence
KRKIGLNEPHH

SEQ ID NO: 8067 - protein, 11 aa, Artificial
  IGFBP-2 heparin binding domain-containing peptide sequence
RRKIGLNEPHH

SEQ ID NO: 8068 - protein, 11 aa, Artificial
  IGFBP-2 heparin binding domain-containing peptide sequence
HRKIGLNEPHH

SEQ ID NO: 8069 - protein, 11 aa, Artificial
  IGFBP-2 heparin binding domain-containing peptide sequence
KHRIGLNEPHH

SEQ ID NO: 8070 - protein, 11 aa, Artificial
  IGFBP-2 heparin binding domain-containing peptide sequence
RHRIGLNEPHH

SEQ ID NO: 8071 - protein, 11 aa, Artificial
  IGFBP-2 heparin binding domain-containing peptide sequence
HHRIGLNEPHH

SEQ ID NO: 8072 - protein, 11 aa, Artificial
  IGFBP-2 heparin binding domain-containing peptide sequence
KKRIGLNEPHH

SEQ ID NO: 8073 - protein, 11 aa, Artificial
  IGFBP-2 heparin binding domain-containing peptide sequence
RKRIGLNEPHH

SEQ ID NO: 8074 - protein, 11 aa, Artificial
  IGFBP-2 heparin binding domain-containing peptide sequence
HKRIGLNEPHH

SEQ ID NO: 8075 - protein, 11 aa, Artificial
  IGFBP-2 heparin binding domain-containing peptide sequence
KRRIGLNEPHH

SEQ ID NO: 8076 - protein, 11 aa, Artificial
  IGFBP-2 heparin binding domain-containing peptide sequence
RRRIGLNEPHH

SEQ ID NO: 8077 - protein, 11 aa, Artificial
  IGFBP-2 heparin binding domain-containing peptide sequence
HRRIGLNEPHH

SEQ ID NO: 8078 - protein, 11 aa, Artificial
  IGFBP-2 heparin binding domain-containing peptide sequence
KHHVGLNEPHH

SEQ ID NO: 8079 - protein, 11 aa, Artificial
  IGFBP-2 heparin binding domain-containing peptide sequence
RHHVGLNEPHH

SEQ ID NO: 8080 - protein, 11 aa, Artificial
  IGFBP-2 heparin binding domain-containing peptide sequence
HHHVGLNEPHH

SEQ ID NO: 8081 - protein, 11 aa, Artificial
  IGFBP-2 heparin binding domain-containing peptide sequence
KKHVGLNEPHH

SEQ ID NO: 8082 - protein, 11 aa, Artificial
  IGFBP-2 heparin binding domain-containing peptide sequence
RKHVGLNEPHH

SEQ ID NO: 8083 - protein, 11 aa, Artificial
  IGFBP-2 heparin binding domain-containing peptide sequence
HKHVGLNEPHH

SEQ ID NO: 8084 - protein, 11 aa, Artificial
  IGFBP-2 heparin binding domain-containing peptide sequence
KRHVGLNEPHH

SEQ ID NO: 8085 - protein, 11 aa, Artificial
  IGFBP-2 heparin binding domain-containing peptide sequence
RRHVGLNEPHH

SEQ ID NO: 8086 - protein, 11 aa, Artificial
  IGFBP-2 heparin binding domain-containing peptide sequence
HRHVGLNEPHH

SEQ ID NO: 8087 - protein, 11 aa, Artificial
  IGFBP-2 heparin binding domain-containing peptide sequence
KHKVGLNEPHH

SEQ ID NO: 8088 - protein, 11 aa, Artificial
  IGFBP-2 heparin binding domain-containing peptide sequence
RHKVGLNEPHH

SEQ ID NO: 8089 - protein, 11 aa, Artificial
  IGFBP-2 heparin binding domain-containing peptide sequence
HHKVGLNEPHH

SEQ ID NO: 8090 - protein, 11 aa, Artificial
  IGFBP-2 heparin binding domain-containing peptide sequence
KKKVGLNEPHH

SEQ ID NO: 8091 - protein, 11 aa, Artificial
  IGFBP-2 heparin binding domain-containing peptide sequence
RKKVGLNEPHH

SEQ ID NO: 8092 - protein, 11 aa, Artificial
  IGFBP-2 heparin binding domain-containing peptide sequence
HKKVGLNEPHH

SEQ ID NO: 8093 - protein, 11 aa, Artificial
  IGFBP-2 heparin binding domain-containing peptide sequence
KRKVGLNEPHH

SEQ ID NO: 8094 - protein, 11 aa, Artificial
  IGFBP-2 heparin binding domain-containing peptide sequence
RRKVGLNEPHH

SEQ ID NO: 8095 - protein, 11 aa, Artificial
  IGFBP-2 heparin binding domain-containing peptide sequence
HRKVGLNEPHH

SEQ ID NO: 8096 - protein, 11 aa, Artificial
  IGFBP-2 heparin binding domain-containing peptide sequence
KHRVGLNEPHH

SEQ ID NO: 8097 - protein, 11 aa, Artificial
  IGFBP-2 heparin binding domain-containing peptide sequence
RHRVGLNEPHH

SEQ ID NO: 8098 - protein, 11 aa, Artificial
  IGFBP-2 heparin binding domain-containing peptide sequence
HHRVGLNEPHH

SEQ ID NO: 8099 - protein, 11 aa, Artificial
  IGFBP-2 heparin binding domain-containing peptide sequence
KKRVGLNEPHH

SEQ ID NO: 8100 - protein, 11 aa, Artificial
  IGFBP-2 heparin binding domain-containing peptide sequence
RKRVGLNEPHH

SEQ ID NO: 8101 - protein, 11 aa, Artificial
  IGFBP-2 heparin binding domain-containing peptide sequence
HKRVGLNEPHH

SEQ ID NO: 8102 - protein, 11 aa, Artificial
  IGFBP-2 heparin binding domain-containing peptide sequence
KRRVGLNEPHH

SEQ ID NO: 8103 - protein, 11 aa, Artificial
  IGFBP-2 heparin binding domain-containing peptide sequence
RRRVGLNEPHH

SEQ ID NO: 8104 - protein, 11 aa, Artificial
  IGFBP-2 heparin binding domain-containing peptide sequence
HRRVGLNEPHH

SEQ ID NO: 8105 - protein, 11 aa, Artificial
  IGFBP-2 heparin binding domain-containing peptide sequence
KHHLGINEPHH

SEQ ID NO: 8106 - protein, 11 aa, Artificial
  IGFBP-2 heparin binding domain-containing peptide sequence
RHHLGINEPHH

SEQ ID NO: 8107 - protein, 11 aa, Artificial
  IGFBP-2 heparin binding domain-containing peptide sequence
HHHLGINEPHH

SEQ ID NO: 8108 - protein, 11 aa, Artificial
  IGFBP-2 heparin binding domain-containing peptide sequence
KKHLGINEPHH

SEQ ID NO: 8109 - protein, 11 aa, Artificial
  IGFBP-2 heparin binding domain-containing peptide sequence
RKHLGINEPHH

SEQ ID NO: 8110 - protein, 11 aa, Artificial
  IGFBP-2 heparin binding domain-containing peptide sequence
HKHLGINEPHH

SEQ ID NO: 8111 - protein, 11 aa, Artificial
  IGFBP-2 heparin binding domain-containing peptide sequence
KRHLGINEPHH

SEQ ID NO: 8112 - protein, 11 aa, Artificial
  IGFBP-2 heparin binding domain-containing peptide sequence
RRHLGINEPHH

SEQ ID NO: 8113 - protein, 11 aa, Artificial
  IGFBP-2 heparin binding domain-containing peptide sequence
HRHLGINEPHH

SEQ ID NO: 8114 - protein, 11 aa, Artificial
  IGFBP-2 heparin binding domain-containing peptide sequence
KHKLGINEPHH

SEQ ID NO: 8115 - protein, 11 aa, Artificial
  IGFBP-2 heparin binding domain-containing peptide sequence
RHKLGINEPHH

SEQ ID NO: 8116 - protein, 11 aa, Artificial
  IGFBP-2 heparin binding domain-containing peptide sequence
HHKLGINEPHH

SEQ ID NO: 8117 - protein, 11 aa, Artificial
  IGFBP-2 heparin binding domain-containing peptide sequence
KKKLGINEPHH

SEQ ID NO: 8118 - protein, 11 aa, Artificial
  IGFBP-2 heparin binding domain-containing peptide sequence
RKKLGINEPHH

SEQ ID NO: 8119 - protein, 11 aa, Artificial
  IGFBP-2 heparin binding domain-containing peptide sequence
HKKLGINEPHH

SEQ ID NO: 8120 - protein, 11 aa, Artificial
  IGFBP-2 heparin binding domain-containing peptide sequence
KRKLGINEPHH

SEQ ID NO: 8121 - protein, 11 aa, Artificial
  IGFBP-2 heparin binding domain-containing peptide sequence
RRKLGINEPHH

SEQ ID NO: 8122 - protein, 11 aa, Artificial
  IGFBP-2 heparin binding domain-containing peptide sequence
HRKLGINEPHH

SEQ ID NO: 8123 - protein, 11 aa, Artificial
  IGFBP-2 heparin binding domain-containing peptide sequence
KHRLGINEPHH

SEQ ID NO: 8124 - protein, 11 aa, Artificial
  IGFBP-2 heparin binding domain-containing peptide sequence
RHRLGINEPHH

SEQ ID NO: 8125 - protein, 11 aa, Artificial
  IGFBP-2 heparin binding domain-containing peptide sequence
HHRLGINEPHH

SEQ ID NO: 8126 - protein, 11 aa, Artificial
  IGFBP-2 heparin binding domain-containing peptide sequence
KKRLGINEPHH

SEQ ID NO: 8127 - protein, 11 aa, Artificial
  IGFBP-2 heparin binding domain-containing peptide sequence
RKRLGINEPHH

SEQ ID NO: 8128 - protein, 11 aa, Artificial
  IGFBP-2 heparin binding domain-containing peptide sequence
HKRLGINEPHH

SEQ ID NO: 8129 - protein, 11 aa, Artificial
  IGFBP-2 heparin binding domain-containing peptide sequence
KRRLGINEPHH

SEQ ID NO: 8130 - protein, 11 aa, Artificial
  IGFBP-2 heparin binding domain-containing peptide sequence
RRRLGINEPHH

SEQ ID NO: 8131 - protein, 11 aa, Artificial
  IGFBP-2 heparin binding domain-containing peptide sequence
HRRLGINEPHH

SEQ ID NO: 8132 - protein, 11 aa, Artificial
  IGFBP-2 heparin binding domain-containing peptide sequence
KHHIGIENPHH

SEQ ID NO: 8133 - protein, 11 aa, Artificial
  IGFBP-2 heparin binding domain-containing peptide sequence
RHHIGINEPHH

SEQ ID NO: 8134 - protein, 11 aa, Artificial
  IGFBP-2 heparin binding domain-containing peptide sequence
HHHIGINEPHH

SEQ ID NO: 8135 - protein, 11 aa, Artificial
  IGFBP-2 heparin binding domain-containing peptide sequence
KKHIGINEPHH

SEQ ID NO: 8136 - protein, 11 aa, Artificial
  IGFBP-2 heparin binding domain-containing peptide sequence
RKHIGINEPHH

SEQ ID NO: 8137 - protein, 11 aa, Artificial
  IGFBP-2 heparin binding domain-containing peptide sequence
HKHIGINEPHH

SEQ ID NO: 8138 - protein, 11 aa, Artificial
  IGFBP-2 heparin binding domain-containing peptide sequence
KRHIGINEPHH

SEQ ID NO: 8139 - protein, 11 aa, Artificial
  IGFBP-2 heparin binding domain-containing peptide sequence
RRHIGINEPHH

SEQ ID NO: 8140 - protein, 11 aa, Artificial
  IGFBP-2 heparin binding domain-containing peptide sequence
HRHIGINEPHH

SEQ ID NO: 8141 - protein, 11 aa, Artificial
  IGFBP-2 heparin binding domain-containing peptide sequence
KHKIGINEPHH

SEQ ID NO: 8142 - protein, 11 aa, Artificial
  IGFBP-2 heparin binding domain-containing peptide sequence
RHKIGINEPHH

SEQ ID NO: 8143 - protein, 11 aa, Artificial
  IGFBP-2 heparin binding domain-containing peptide sequence
HHKIGINEPHH

SEQ ID NO: 8144 - protein, 11 aa, Artificial
  IGFBP-2 heparin binding domain-containing peptide sequence
KKKIGINEPHH

SEQ ID NO: 8145 - protein, 11 aa, Artificial
  IGFBP-2 heparin binding domain-containing peptide sequence
RKKIGINEPHH

SEQ ID NO: 8146 - protein, 11 aa, Artificial
  IGFBP-2 heparin binding domain-containing peptide sequence
HKKIGINEPHH

SEQ ID NO: 8147 - protein, 11 aa, Artificial
  IGFBP-2 heparin binding domain-containing peptide sequence
KRKIGINEPHH

SEQ ID NO: 8148 - protein, 11 aa, Artificial
  IGFBP-2 heparin binding domain-containing peptide sequence
RRKIGINEPHH

SEQ ID NO: 8149 - protein, 11 aa, Artificial
  IGFBP-2 heparin binding domain-containing peptide sequence
HRKIGINEPHH

SEQ ID NO: 8150 - protein, 11 aa, Artificial
  IGFBP-2 heparin binding domain-containing peptide sequence
KHRIGINEPHH

SEQ ID NO: 8151 - protein, 11 aa, Artificial
  IGFBP-2 heparin binding domain-containing peptide sequence
RHRIGINEPHH

SEQ ID NO: 8152 - protein, 11 aa, Artificial
  IGFBP-2 heparin binding domain-containing peptide sequence
HHRIGINEPHH

SEQ ID NO: 8153 - protein, 11 aa, Artificial
  IGFBP-2 heparin binding domain-containing peptide sequence
KKRIGINEPHH

SEQ ID NO: 8154 - protein, 11 aa, Artificial
  IGFBP-2 heparin binding domain-containing peptide sequence
RKRIGINEPHH

SEQ ID NO: 8155 - protein, 11 aa, Artificial
  IGFBP-2 heparin binding domain-containing peptide sequence
HKRIGINEPHH

SEQ ID NO: 8156 - protein, 11 aa, Artificial
  IGFBP-2 heparin binding domain-containing peptide sequence
KRRIGINEPHH

SEQ ID NO: 8157 - protein, 11 aa, Artificial
  IGFBP-2 heparin binding domain-containing peptide sequence
RRRIGINEPHH

SEQ ID NO: 8158 - protein, 11 aa, Artificial
  IGFBP-2 heparin binding domain-containing peptide sequence
HRRIGINEPHH

SEQ ID NO: 8159 - protein, 11 aa, Artificial
  IGFBP-2 heparin binding domain-containing peptide sequence
KHHVGINEPHH

SEQ ID NO: 8160 - protein, 11 aa, Artificial
  IGFBP-2 heparin binding domain-containing peptide sequence
RHHVGINEPHH

SEQ ID NO: 8161 - protein, 11 aa, Artificial
  IGFBP-2 heparin binding domain-containing peptide sequence
HHHVGINEPHH

SEQ ID NO: 8162 - protein, 11 aa, Artificial
  IGFBP-2 heparin binding domain-containing peptide sequence
KKHVGINEPHH

SEQ ID NO: 8163 - protein, 11 aa, Artificial
  IGFBP-2 heparin binding domain-containing peptide sequence
RKHVGINEPHH

SEQ ID NO: 8164 - protein, 11 aa, Artificial
  IGFBP-2 heparin binding domain-containing peptide sequence
HKHVGINEPHH

SEQ ID NO: 8165 - protein, 11 aa, Artificial
  IGFBP-2 heparin binding domain-containing peptide sequence
KRHVGINEPHH

SEQ ID NO: 8166 - protein, 11 aa, Artificial
  IGFBP-2 heparin binding domain-containing peptide sequence
RRHVGINEPHH

SEQ ID NO: 8167 - protein, 11 aa, Artificial
  IGFBP-2 heparin binding domain-containing peptide sequence
HRHVGINEPHH

SEQ ID NO: 8168 - protein, 11 aa, Artificial
  IGFBP-2 heparin binding domain-containing peptide sequence
KHKVGINEPHH

SEQ ID NO: 8169 - protein, 11 aa, Artificial
  IGFBP-2 heparin binding domain-containing peptide sequence
RHKVGINEPHH

SEQ ID NO: 8170 - protein, 11 aa, Artificial
  IGFBP-2 heparin binding domain-containing peptide sequence
HHKVGINEPHH

SEQ ID NO: 8171 - protein, 11 aa, Artificial
  IGFBP-2 heparin binding domain-containing peptide sequence
KKKVGINEPHH

SEQ ID NO: 8172 - protein, 11 aa, Artificial
  IGFBP-2 heparin binding domain-containing peptide sequence
RKKVGINEPHH

SEQ ID NO: 8173 - protein, 11 aa, Artificial
  IGFBP-2 heparin binding domain-containing peptide sequence
HKKVGINEPHH

SEQ ID NO: 8174 - protein, 11 aa, Artificial
  IGFBP-2 heparin binding domain-containing peptide sequence
KRKVGINEPHH

SEQ ID NO: 8175 - protein, 11 aa, Artificial
  IGFBP-2 heparin binding domain-containing peptide sequence
RRKVGINEPHH

SEQ ID NO: 8176 - protein, 11 aa, Artificial
  IGFBP-2 heparin binding domain-containing peptide sequence
HRKVGINEPHH

SEQ ID NO: 8177 - protein, 11 aa, Artificial
  IGFBP-2 heparin binding domain-containing peptide sequence
KHRVGINEPHH

SEQ ID NO: 8178 - protein, 11 aa, Artificial
  IGFBP-2 heparin binding domain-containing peptide sequence
RHRVGINEPHH

SEQ ID NO: 8179 - protein, 11 aa, Artificial
  IGFBP-2 heparin binding domain-containing peptide sequence
HHRVGINEPHH

SEQ ID NO: 8180 - protein, 11 aa, Artificial
  IGFBP-2 heparin binding domain-containing peptide sequence
KKRVGINEPHH

SEQ ID NO: 8181 - protein, 11 aa, Artificial
  IGFBP-2 heparin binding domain-containing peptide sequence
RKRVGINEPHH

SEQ ID NO: 8182 - protein, 11 aa, Artificial
  IGFBP-2 heparin binding domain-containing peptide sequence
HKRVGINEPHH

SEQ ID NO: 8183 - protein, 11 aa, Artificial
  IGFBP-2 heparin binding domain-containing peptide sequence
KRRVGINEPHH

SEQ ID NO: 8184 - protein, 11 aa, Artificial
  IGFBP-2 heparin binding domain-containing peptide sequence
RRRVGINEPHH

SEQ ID NO: 8185 - protein, 11 aa, Artificial
  IGFBP-2 heparin binding domain-containing peptide sequence
HRRVGINEPHH

SEQ ID NO: 8186 - protein, 11 aa, Artificial
  IGFBP-2 heparin binding domain-containing peptide sequence
KHHLGVNEPHH

SEQ ID NO: 8187 - protein, 11 aa, Artificial
  IGFBP-2 heparin binding domain-containing peptide sequence
RHHLGVNEPHH

SEQ ID NO: 8188 - protein, 11 aa, Artificial
  IGFBP-2 heparin binding domain-containing peptide sequence
HHHLGVNEPHH

SEQ ID NO: 8189 - protein, 11 aa, Artificial
  IGFBP-2 heparin binding domain-containing peptide sequence
KKHLGVNEPHH

SEQ ID NO: 8190 - protein, 11 aa, Artificial
  IGFBP-2 heparin binding domain-containing peptide sequence
RKHLGVNEPHH

SEQ ID NO: 8191 - protein, 11 aa, Artificial
  IGFBP-2 heparin binding domain-containing peptide sequence
HKHLGVNEPHH

SEQ ID NO: 8192 - protein, 11 aa, Artificial
  IGFBP-2 heparin binding domain-containing peptide sequence
KRHLGVNEPHH

SEQ ID NO: 8193 - protein, 11 aa, Artificial
  IGFBP-2 heparin binding domain-containing peptide sequence
RRHLGVNEPHH

SEQ ID NO: 8194 - protein, 11 aa, Artificial
  IGFBP-2 heparin binding domain-containing peptide sequence
HRHLGVNEPHH

SEQ ID NO: 8195 - protein, 11 aa, Artificial
  IGFBP-2 heparin binding domain-containing peptide sequence
KHKLGVNEPHH

SEQ ID NO: 8196 - protein, 11 aa, Artificial
  IGFBP-2 heparin binding domain-containing peptide sequence
RHKLGVNEPHH

SEQ ID NO: 8197 - protein, 11 aa, Artificial
  IGFBP-2 heparin binding domain-containing peptide sequence
HHKLGVNEPHH

SEQ ID NO: 8198 - protein, 11 aa, Artificial
  IGFBP-2 heparin binding domain-containing peptide sequence
KKKLGVNEPHH

SEQ ID NO: 8199 - protein, 11 aa, Artificial
  IGFBP-2 heparin binding domain-containing peptide sequence
RKKLGVNEPHH

SEQ ID NO: 8200 - protein, 11 aa, Artificial
  IGFBP-2 heparin binding domain-containing peptide sequence
HKKLGVNEPHH

SEQ ID NO: 8201 - protein, 11 aa, Artificial
  IGFBP-2 heparin binding domain-containing peptide sequence
KRKLGVNEPHH

SEQ ID NO: 8202 - protein, 11 aa, Artificial
  IGFBP-2 heparin binding domain-containing peptide sequence
RRKLGVNEPHH

SEQ ID NO: 8203 - protein, 11 aa, Artificial
  IGFBP-2 heparin binding domain-containing peptide sequence
HRKLGVNEPHH

SEQ ID NO: 8204 - protein, 11 aa, Artificial
  IGFBP-2 heparin binding domain-containing peptide sequence
KHRLGVNEPHH

SEQ ID NO: 8205 - protein, 11 aa, Artificial
  IGFBP-2 heparin binding domain-containing peptide sequence
RHRLGVNEPHH

SEQ ID NO: 8206 - protein, 11 aa, Artificial
  IGFBP-2 heparin binding domain-containing peptide sequence
HHRLGVNEPHH

SEQ ID NO: 8207 - protein, 11 aa, Artificial
  IGFBP-2 heparin binding domain-containing peptide sequence
KKRLGVNEPHH

SEQ ID NO: 8208 - protein, 11 aa, Artificial
  IGFBP-2 heparin binding domain-containing peptide sequence
RKRLGVNEPHH

SEQ ID NO: 8209 - protein, 11 aa, Artificial
  IGFBP-2 heparin binding domain-containing peptide sequence
HKRLGVNEPHH

SEQ ID NO: 8210 - protein, 11 aa, Artificial
  IGFBP-2 heparin binding domain-containing peptide sequence
KRRLGVNEPHH

SEQ ID NO: 8211 - protein, 11 aa, Artificial
  IGFBP-2 heparin binding domain-containing peptide sequence
RRRLGVNEPHH

SEQ ID NO: 8212 - protein, 11 aa, Artificial
  IGFBP-2 heparin binding domain-containing peptide sequence
HRRLGVNEPHH

SEQ ID NO: 8213 - protein, 11 aa, Artificial
  IGFBP-2 heparin binding domain-containing peptide sequence
KHHIGVNEPHH

SEQ ID NO: 8214 - protein, 11 aa, Artificial
  IGFBP-2 heparin binding domain-containing peptide sequence
RHHIGVNEPHH

SEQ ID NO: 8215 - protein, 11 aa, Artificial
  IGFBP-2 heparin binding domain-containing peptide sequence
HHHIGVNEPHH

SEQ ID NO: 8216 - protein, 11 aa, Artificial
  IGFBP-2 heparin binding domain-containing peptide sequence
KKHIGVNEPHH

SEQ ID NO: 8217 - protein, 11 aa, Artificial
  IGFBP-2 heparin binding domain-containing peptide sequence
RKHIGVNEPHH

SEQ ID NO: 8218 - protein, 11 aa, Artificial
  IGFBP-2 heparin binding domain-containing peptide sequence
HKHIGVNEPHH

SEQ ID NO: 8219 - protein, 11 aa, Artificial
  IGFBP-2 heparin binding domain-containing peptide sequence
KRHIGVNEPHH

SEQ ID NO: 8220 - protein, 11 aa, Artificial
  IGFBP-2 heparin binding domain-containing peptide sequence
RRHIGVNEPHH

SEQ ID NO: 8221 - protein, 11 aa, Artificial
  IGFBP-2 heparin binding domain-containing peptide sequence
HRHIGVNEPHH

SEQ ID NO: 8222 - protein, 11 aa, Artificial
  IGFBP-2 heparin binding domain-containing peptide sequence
KHKIGVNEPHH

SEQ ID NO: 8223 - protein, 11 aa, Artificial
  IGFBP-2 heparin binding domain-containing peptide sequence
RHKIGVNEPHH

SEQ ID NO: 8224 - protein, 11 aa, Artificial
  IGFBP-2 heparin binding domain-containing peptide sequence
HHKIGVNEPHH

SEQ ID NO: 8225 - protein, 11 aa, Artificial
  IGFBP-2 heparin binding domain-containing peptide sequence
KKKIGVNEPHH

SEQ ID NO: 8226 - protein, 11 aa, Artificial
  IGFBP-2 heparin binding domain-containing peptide sequence
RKKIGVNEPHH

SEQ ID NO: 8227 - protein, 11 aa, Artificial
  IGFBP-2 heparin binding domain-containing peptide sequence
HKKIGVNEPHH

SEQ ID NO: 8228 - protein, 11 aa, Artificial
  IGFBP-2 heparin binding domain-containing peptide sequence
KRKIGVNEPHH

SEQ ID NO: 8229 - protein, 11 aa, Artificial
  IGFBP-2 heparin binding domain-containing peptide sequence
RRKIGVNEPHH

SEQ ID NO: 8230 - protein, 11 aa, Artificial
  IGFBP-2 heparin binding domain-containing peptide sequence
HRKIGVNEPHH

SEQ ID NO: 8231 - protein, 11 aa, Artificial
  IGFBP-2 heparin binding domain-containing peptide sequence
KHRIGVNEPHH

SEQ ID NO: 8232 - protein, 11 aa, Artificial
  IGFBP-2 heparin binding domain-containing peptide sequence
RHRIGVNEPHH

SEQ ID NO: 8233 - protein, 11 aa, Artificial
  IGFBP-2 heparin binding domain-containing peptide sequence
HHRIGVNEPHH

SEQ ID NO: 8234 - protein, 11 aa, Artificial
  IGFBP-2 heparin binding domain-containing peptide sequence
KKRIGVNEPHH

SEQ ID NO: 8235 - protein, 11 aa, Artificial
  IGFBP-2 heparin binding domain-containing peptide sequence
RKRIGVNEPHH

SEQ ID NO: 8236 - protein, 11 aa, Artificial
  IGFBP-2 heparin binding domain-containing peptide sequence
HKRIGVNEPHH

SEQ ID NO: 8237 - protein, 11 aa, Artificial
  IGFBP-2 heparin binding domain-containing peptide sequence
KRRIGVNEPHH

SEQ ID NO: 8238 - protein, 11 aa, Artificial
  IGFBP-2 heparin binding domain-containing peptide sequence
RRRIGVNEPHH

SEQ ID NO: 8239 - protein, 11 aa, Artificial
  IGFBP-2 heparin binding domain-containing peptide sequence
HRRIGVNEPHH

SEQ ID NO: 8240 - protein, 11 aa, Artificial
  IGFBP-2 heparin binding domain-containing peptide sequence
KHHVGVNEPHH

SEQ ID NO: 8241 - protein, 11 aa, Artificial
  IGFBP-2 heparin binding domain-containing peptide sequence
RHHVGVNEPHH

SEQ ID NO: 8242 - protein, 11 aa, Artificial
  IGFBP-2 heparin binding domain-containing peptide sequence
HHHVGVNEPHH

SEQ ID NO: 8243 - protein, 11 aa, Artificial
  IGFBP-2 heparin binding domain-containing peptide sequence
KKHVGVNEPHH

SEQ ID NO: 8244 - protein, 11 aa, Artificial
  IGFBP-2 heparin binding domain-containing peptide sequence
RKHVGVNEPHH

SEQ ID NO: 8245 - protein, 11 aa, Artificial
  IGFBP-2 heparin binding domain-containing peptide sequence
HKHVGVNEPHH

SEQ ID NO: 8246 - protein, 11 aa, Artificial
  IGFBP-2 heparin binding domain-containing peptide sequence
KRHVGVNEPHH

SEQ ID NO: 8247 - protein, 11 aa, Artificial
  IGFBP-2 heparin binding domain-containing peptide sequence
RRHVGVNEPHH

SEQ ID NO: 8248 - protein, 11 aa, Artificial
  IGFBP-2 heparin binding domain-containing peptide sequence
HRHVGVNEPHH

SEQ ID NO: 8249 - protein, 11 aa, Artificial
  IGFBP-2 heparin binding domain-containing peptide sequence
KHKVGVNEPHH

SEQ ID NO: 8250 - protein, 11 aa, Artificial
  IGFBP-2 heparin binding domain-containing peptide sequence
RHKVGVNEPHH

SEQ ID NO: 8251 - protein, 11 aa, Artificial
  IGFBP-2 heparin binding domain-containing peptide sequence
HHKVGVNEPHH

SEQ ID NO: 8252 - protein, 11 aa, Artificial
  IGFBP-2 heparin binding domain-containing peptide sequence
KKKVGVNEPHH

SEQ ID NO: 8253 - protein, 11 aa, Artificial
  IGFBP-2 heparin binding domain-containing peptide sequence
RKKVGVNEPHH

SEQ ID NO: 8254 - protein, 11 aa, Artificial
  IGFBP-2 heparin binding domain-containing peptide sequence
HKKVGVNEPHH

SEQ ID NO: 8255 - protein, 11 aa, Artificial
  IGFBP-2 heparin binding domain-containing peptide sequence
KRKVGVNEPHH

SEQ ID NO: 8256 - protein, 11 aa, Artificial
  IGFBP-2 heparin binding domain-containing peptide sequence
RRKVGVNEPHH

SEQ ID NO: 8257 - protein, 11 aa, Artificial
  IGFBP-2 heparin binding domain-containing peptide sequence
HRKVGVNEPHH

SEQ ID NO: 8258 - protein, 11 aa, Artificial
  IGFBP-2 heparin binding domain-containing peptide sequence
KHRVGVNEPHH

SEQ ID NO: 8259 - protein, 11 aa, Artificial
  IGFBP-2 heparin binding domain-containing peptide sequence
RHRVGVNEPHH

SEQ ID NO: 8260 - protein, 11 aa, Artificial
  IGFBP-2 heparin binding domain-containing peptide sequence
HHRVGVNEPHH

SEQ ID NO: 8261 - protein, 11 aa, Artificial
  IGFBP-2 heparin binding domain-containing peptide sequence
KKRVGVNEPHH

SEQ ID NO: 8262 - protein, 11 aa, Artificial
  IGFBP-2 heparin binding domain-containing peptide sequence
RKRVGVNEPHH

SEQ ID NO: 8263 - protein, 11 aa, Artificial
  IGFBP-2 heparin binding domain-containing peptide sequence
HKRVGVNEPHH

SEQ ID NO: 8264 - protein, 11 aa, Artificial
  IGFBP-2 heparin binding domain-containing peptide sequence
KRRVGVNEPHH

SEQ ID NO: 8265 - protein, 11 aa, Artificial
  IGFBP-2 heparin binding domain-containing peptide sequence
RRRVGVNEPHH

SEQ ID NO: 8266 - protein, 11 aa, Artificial
  IGFBP-2 heparin binding domain-containing peptide sequence
HRRVGVNEPHH

SEQ ID NO: 8267 - protein, 11 aa, Artificial
  IGFBP-2 heparin binding domain-containing peptide sequence
KHHLGLENPHH

SEQ ID NO: 8268 - protein, 11 aa, Artificial
  IGFBP-2 heparin binding domain-containing peptide sequence
RHHLGLENPHH

SEQ ID NO: 8269 - protein, 11 aa, Artificial
  IGFBP-2 heparin binding domain-containing peptide sequence
HHHLGLENPHH

SEQ ID NO: 8270 - protein, 11 aa, Artificial
  IGFBP-2 heparin binding domain-containing peptide sequence
KKHLGLENPHH

SEQ ID NO: 8271 - protein, 11 aa, Artificial
  IGFBP-2 heparin binding domain-containing peptide sequence
RKHLGLENPHH

SEQ ID NO: 8272 - protein, 11 aa, Artificial
  IGFBP-2 heparin binding domain-containing peptide sequence
HKHLGLENPHH

SEQ ID NO: 8273 - protein, 11 aa, Artificial
  IGFBP-2 heparin binding domain-containing peptide sequence
KRHLGLENPHH

SEQ ID NO: 8274 - protein, 11 aa, Artificial
  IGFBP-2 heparin binding domain-containing peptide sequence
RRHLGLENPHH

SEQ ID NO: 8275 - protein, 11 aa, Artificial
  IGFBP-2 heparin binding domain-containing peptide sequence
HRHLGLENPHH

SEQ ID NO: 8276 - protein, 11 aa, Artificial
  IGFBP-2 heparin binding domain-containing peptide sequence
KHKLGLENPHH

SEQ ID NO: 8277 - protein, 11 aa, Artificial
  IGFBP-2 heparin binding domain-containing peptide sequence
RHKLGLENPHH

SEQ ID NO: 8278 - protein, 11 aa, Artificial
  IGFBP-2 heparin binding domain-containing peptide sequence
HHKLGLENPHH

SEQ ID NO: 8279 - protein, 11 aa, Artificial
  IGFBP-2 heparin binding domain-containing peptide sequence
KKKLGLENPHH

SEQ ID NO: 8280 - protein, 11 aa, Artificial
  IGFBP-2 heparin binding domain-containing peptide sequence
RKKLGLENPHH

SEQ ID NO: 8281 - protein, 11 aa, Artificial
  IGFBP-2 heparin binding domain-containing peptide sequence
HKKLGLENPHH

SEQ ID NO: 8282 - protein, 11 aa, Artificial
  IGFBP-2 heparin binding domain-containing peptide sequence
KRKLGLENPHH

SEQ ID NO: 8283 - protein, 11 aa, Artificial
  IGFBP-2 heparin binding domain-containing peptide sequence
RRKLGLENPHH

SEQ ID NO: 8284 - protein, 11 aa, Artificial
  IGFBP-2 heparin binding domain-containing peptide sequence
HRKLGLENPHH

SEQ ID NO: 8285 - protein, 11 aa, Artificial
  IGFBP-2 heparin binding domain-containing peptide sequence
KHRLGLENPHH

SEQ ID NO: 8286 - protein, 11 aa, Artificial
  IGFBP-2 heparin binding domain-containing peptide sequence
RHRLGLENPHH

SEQ ID NO: 8287 - protein, 11 aa, Artificial
  IGFBP-2 heparin binding domain-containing peptide sequence
HHRLGLENPHH

SEQ ID NO: 8288 - protein, 11 aa, Artificial
  IGFBP-2 heparin binding domain-containing peptide sequence
KKRLGLENPHH

SEQ ID NO: 8289 - protein, 11 aa, Artificial
  IGFBP-2 heparin binding domain-containing peptide sequence
RKRLGLENPHH

SEQ ID NO: 8290 - protein, 11 aa, Artificial
  IGFBP-2 heparin binding domain-containing peptide sequence
HKRLGLENPHH

SEQ ID NO: 8291 - protein, 11 aa, Artificial
  IGFBP-2 heparin binding domain-containing peptide sequence
KRRLGLENPHH

SEQ ID NO: 8292 - protein, 11 aa, Artificial
  IGFBP-2 heparin binding domain-containing peptide sequence
RRRLGLENPHH

SEQ ID NO: 8293 - protein, 11 aa, Artificial
  IGFBP-2 heparin binding domain-containing peptide sequence
HRRLGLENPHH

SEQ ID NO: 8294 - protein, 11 aa, Artificial
  IGFBP-2 heparin binding domain-containing peptide sequence
KHHIGLENPHH

SEQ ID NO: 8295 - protein, 11 aa, Artificial
  IGFBP-2 heparin binding domain-containing peptide sequence
RHHIGLENPHH

SEQ ID NO: 8296 - protein, 11 aa, Artificial
  IGFBP-2 heparin binding domain-containing peptide sequence
HHHIGLENPHH

SEQ ID NO: 8297 - protein, 11 aa, Artificial
  IGFBP-2 heparin binding domain-containing peptide sequence
KKHIGLENPHH

SEQ ID NO: 8298 - protein, 11 aa, Artificial
  IGFBP-2 heparin binding domain-containing peptide sequence
RKHIGLENPHH

SEQ ID NO: 8299 - protein, 11 aa, Artificial
  IGFBP-2 heparin binding domain-containing peptide sequence
HKHIGLENPHH

SEQ ID NO: 8300 - protein, 11 aa, Artificial
  IGFBP-2 heparin binding domain-containing peptide sequence
KRHIGLENPHH

SEQ ID NO: 8301 - protein, 11 aa, Artificial
  IGFBP-2 heparin binding domain-containing peptide sequence
RRHIGLENPHH

SEQ ID NO: 8302 - protein, 11 aa, Artificial
  IGFBP-2 heparin binding domain-containing peptide sequence
HRHIGLENPHH

SEQ ID NO: 8303 - protein, 11 aa, Artificial
  IGFBP-2 heparin binding domain-containing peptide sequence
KHKIGLENPHH

SEQ ID NO: 8304 - protein, 11 aa, Artificial
  IGFBP-2 heparin binding domain-containing peptide sequence
RHKIGLENPHH

SEQ ID NO: 8305 - protein, 11 aa, Artificial
  IGFBP-2 heparin binding domain-containing peptide sequence
HHKIGLENPHH

SEQ ID NO: 8306 - protein, 11 aa, Artificial
  IGFBP-2 heparin binding domain-containing peptide sequence
KKKIGLENPHH

SEQ ID NO: 8307 - protein, 11 aa, Artificial
  IGFBP-2 heparin binding domain-containing peptide sequence
RKKIGLENPHH

SEQ ID NO: 8308 - protein, 11 aa, Artificial
  IGFBP-2 heparin binding domain-containing peptide sequence
HKKIGLENPHH

SEQ ID NO: 8309 - protein, 11 aa, Artificial
  IGFBP-2 heparin binding domain-containing peptide sequence
KRKIGLENPHH

SEQ ID NO: 8310 - protein, 11 aa, Artificial
  IGFBP-2 heparin binding domain-containing peptide sequence
RRKIGLENPHH

SEQ ID NO: 8311 - protein, 11 aa, Artificial
  IGFBP-2 heparin binding domain-containing peptide sequence
HRKIGLENPHH

SEQ ID NO: 8312 - protein, 11 aa, Artificial
  IGFBP-2 heparin binding domain-containing peptide sequence
KHRIGLENPHH

SEQ ID NO: 8313 - protein, 11 aa, Artificial
  IGFBP-2 heparin binding domain-containing peptide sequence
RHRIGLENPHH

SEQ ID NO: 8314 - protein, 11 aa, Artificial
  IGFBP-2 heparin binding domain-containing peptide sequence
HHRIGLENPHH

SEQ ID NO: 8315 - protein, 11 aa, Artificial
  IGFBP-2 heparin binding domain-containing peptide sequence
KKRIGLENPHH

SEQ ID NO: 8316 - protein, 11 aa, Artificial
  IGFBP-2 heparin binding domain-containing peptide sequence
RKRIGLENPHH

SEQ ID NO: 8317 - protein, 11 aa, Artificial
  IGFBP-2 heparin binding domain-containing peptide sequence
HKRIGLENPHH

SEQ ID NO: 8318 - protein, 11 aa, Artificial
  IGFBP-2 heparin binding domain-containing peptide sequence
KRRIGLENPHH

SEQ ID NO: 8319 - protein, 11 aa, Artificial
  IGFBP-2 heparin binding domain-containing peptide sequence
RRRIGLENPHH

SEQ ID NO: 8320 - protein, 11 aa, Artificial
  IGFBP-2 heparin binding domain-containing peptide sequence
HRRIGLENPHH

SEQ ID NO: 8321 - protein, 11 aa, Artificial
  IGFBP-2 heparin binding domain-containing peptide sequence
KHHVGLENPHH

SEQ ID NO: 8322 - protein, 11 aa, Artificial
  IGFBP-2 heparin binding domain-containing peptide sequence
RHHVGLENPHH

SEQ ID NO: 8323 - protein, 11 aa, Artificial
  IGFBP-2 heparin binding domain-containing peptide sequence
HHHVGLENPHH

SEQ ID NO: 8324 - protein, 11 aa, Artificial
  IGFBP-2 heparin binding domain-containing peptide sequence
KKHVGLENPHH

SEQ ID NO: 8325 - protein, 11 aa, Artificial
  IGFBP-2 heparin binding domain-containing peptide sequence
RKHVGLENPHH

SEQ ID NO: 8326 - protein, 11 aa, Artificial
  IGFBP-2 heparin binding domain-containing peptide sequence
HKHVGLENPHH

SEQ ID NO: 8327 - protein, 11 aa, Artificial
  IGFBP-2 heparin binding domain-containing peptide sequence
KRHVGLENPHH

SEQ ID NO: 8328 - protein, 11 aa, Artificial
  IGFBP-2 heparin binding domain-containing peptide sequence
RRHVGLENPHH

SEQ ID NO: 8329 - protein, 11 aa, Artificial
  IGFBP-2 heparin binding domain-containing peptide sequence
HRHVGLENPHH

SEQ ID NO: 8330 - protein, 11 aa, Artificial
  IGFBP-2 heparin binding domain-containing peptide sequence
KHKVGLENPHH

SEQ ID NO: 8331 - protein, 11 aa, Artificial
  IGFBP-2 heparin binding domain-containing peptide sequence
RHKVGLENPHH

SEQ ID NO: 8332 - protein, 11 aa, Artificial
  IGFBP-2 heparin binding domain-containing peptide sequence
HHKVGLENPHH

SEQ ID NO: 8333 - protein, 11 aa, Artificial
  IGFBP-2 heparin binding domain-containing peptide sequence
KKKVGLENPHH

SEQ ID NO: 8334 - protein, 11 aa, Artificial
  IGFBP-2 heparin binding domain-containing peptide sequence
RKKVGLENPHH

SEQ ID NO: 8335 - protein, 11 aa, Artificial
  IGFBP-2 heparin binding domain-containing peptide sequence
HKKVGLENPHH

SEQ ID NO: 8336 - protein, 11 aa, Artificial
  IGFBP-2 heparin binding domain-containing peptide sequence
KRKVGLENPHH

SEQ ID NO: 8337 - protein, 11 aa, Artificial
  IGFBP-2 heparin binding domain-containing peptide sequence
RRKVGLENPHH

SEQ ID NO: 8338 - protein, 11 aa, Artificial
  IGFBP-2 heparin binding domain-containing peptide sequence
HRKVGLENPHH

SEQ ID NO: 8339 - protein, 11 aa, Artificial
  IGFBP-2 heparin binding domain-containing peptide sequence
KHRVGLENPHH

SEQ ID NO: 8340 - protein, 11 aa, Artificial
  IGFBP-2 heparin binding domain-containing peptide sequence
RHRVGLENPHH

SEQ ID NO: 8341 - protein, 11 aa, Artificial
  IGFBP-2 heparin binding domain-containing peptide sequence
HHRVGLENPHH

SEQ ID NO: 8342 - protein, 11 aa, Artificial
  IGFBP-2 heparin binding domain-containing peptide sequence
KKRVGLENPHH

SEQ ID NO: 8343 - protein, 11 aa, Artificial
  IGFBP-2 heparin binding domain-containing peptide sequence
RKRVGLENPHH

SEQ ID NO: 8344 - protein, 11 aa, Artificial
  IGFBP-2 heparin binding domain-containing peptide sequence
HKRVGLENPHH

SEQ ID NO: 8345 - protein, 11 aa, Artificial
  IGFBP-2 heparin binding domain-containing peptide sequence
KRRVGLENPHH

SEQ ID NO: 8346 - protein, 11 aa, Artificial
  IGFBP-2 heparin binding domain-containing peptide sequence
RRRVGLENPHH

SEQ ID NO: 8347 - protein, 11 aa, Artificial
  IGFBP-2 heparin binding domain-containing peptide sequence
HRRVGLENPHH

SEQ ID NO: 8348 - protein, 11 aa, Artificial
  IGFBP-2 heparin binding domain-containing peptide sequence
KHHLGIENPHH

SEQ ID NO: 8349 - protein, 11 aa, Artificial
  IGFBP-2 heparin binding domain-containing peptide sequence
RHHLGIENPHH

SEQ ID NO: 8350 - protein, 11 aa, Artificial
  IGFBP-2 heparin binding domain-containing peptide sequence
HHHLGIENPHH

SEQ ID NO: 8351 - protein, 11 aa, Artificial
  IGFBP-2 heparin binding domain-containing peptide sequence
KKHLGIENPHH

SEQ ID NO: 8352 - protein, 11 aa, Artificial
  IGFBP-2 heparin binding domain-containing peptide sequence
RKHLGIENPHH

SEQ ID NO: 8353 - protein, 11 aa, Artificial
  IGFBP-2 heparin binding domain-containing peptide sequence
HKHLGIENPHH

SEQ ID NO: 8354 - protein, 11 aa, Artificial
  IGFBP-2 heparin binding domain-containing peptide sequence
KRHLGIENPHH

SEQ ID NO: 8355 - protein, 11 aa, Artificial
  IGFBP-2 heparin binding domain-containing peptide sequence
RRHLGIENPHH

SEQ ID NO: 8356 - protein, 11 aa, Artificial
  IGFBP-2 heparin binding domain-containing peptide sequence
HRHLGIENPHH

SEQ ID NO: 8357 - protein, 11 aa, Artificial
  IGFBP-2 heparin binding domain-containing peptide sequence
KHKLGIENPHH

SEQ ID NO: 8358 - protein, 11 aa, Artificial
  IGFBP-2 heparin binding domain-containing peptide sequence
RHKLGIENPHH

SEQ ID NO: 8359 - protein, 11 aa, Artificial
  IGFBP-2 heparin binding domain-containing peptide sequence
HHKLGIENPHH

SEQ ID NO: 8360 - protein, 11 aa, Artificial
  IGFBP-2 heparin binding domain-containing peptide sequence
KKKLGIENPHH

SEQ ID NO: 8361 - protein, 11 aa, Artificial
  IGFBP-2 heparin binding domain-containing peptide sequence
RKKLGIENPHH

SEQ ID NO: 8362 - protein, 11 aa, Artificial
  IGFBP-2 heparin binding domain-containing peptide sequence
HKKLGIENPHH

SEQ ID NO: 8363 - protein, 11 aa, Artificial
  IGFBP-2 heparin binding domain-containing peptide sequence
KRKLGIENPHH

SEQ ID NO: 8364 - protein, 11 aa, Artificial
  IGFBP-2 heparin binding domain-containing peptide sequence
RRKLGIENPHH

SEQ ID NO: 8365 - protein, 11 aa, Artificial
  IGFBP-2 heparin binding domain-containing peptide sequence
HRKLGIENPHH

SEQ ID NO: 8366 - protein, 11 aa, Artificial
  IGFBP-2 heparin binding domain-containing peptide sequence
KHRLGIENPHH

SEQ ID NO: 8367 - protein, 11 aa, Artificial
  IGFBP-2 heparin binding domain-containing peptide sequence
RHRLGIENPHH

SEQ ID NO: 8368 - protein, 11 aa, Artificial
  IGFBP-2 heparin binding domain-containing peptide sequence
HHRLGIENPHH

SEQ ID NO: 8369 - protein, 11 aa, Artificial
  IGFBP-2 heparin binding domain-containing peptide sequence
KKRLGIENPHH

SEQ ID NO: 8370 - protein, 11 aa, Artificial
  IGFBP-2 heparin binding domain-containing peptide sequence
RKRLGIENPHH

SEQ ID NO: 8371 - protein, 11 aa, Artificial
  IGFBP-2 heparin binding domain-containing peptide sequence
HKRLGIENPHH

SEQ ID NO: 8372 - protein, 11 aa, Artificial
  IGFBP-2 heparin binding domain-containing peptide sequence
KRRLGIENPHH

SEQ ID NO: 8373 - protein, 11 aa, Artificial
  IGFBP-2 heparin binding domain-containing peptide sequence
RRRLGIENPHH

SEQ ID NO: 8374 - protein, 11 aa, Artificial
  IGFBP-2 heparin binding domain-containing peptide sequence
HRRLGIENPHH

SEQ ID NO: 8375 - protein, 11 aa, Artificial
  IGFBP-2 heparin binding domain-containing peptide sequence
KHHIGIENPHH

SEQ ID NO: 8376 - protein, 11 aa, Artificial
  IGFBP-2 heparin binding domain-containing peptide sequence
RHHIGIENPHH

SEQ ID NO: 8377 - protein, 11 aa, Artificial
  IGFBP-2 heparin binding domain-containing peptide sequence
HHHIGIENPHH

SEQ ID NO: 8378 - protein, 11 aa, Artificial
  IGFBP-2 heparin binding domain-containing peptide sequence
KKHIGIENPHH

SEQ ID NO: 8379 - protein, 11 aa, Artificial
  IGFBP-2 heparin binding domain-containing peptide sequence
RKHIGIENPHH

SEQ ID NO: 8380 - protein, 11 aa, Artificial
  IGFBP-2 heparin binding domain-containing peptide sequence
HKHIGIENPHH

SEQ ID NO: 8381 - protein, 11 aa, Artificial
  IGFBP-2 heparin binding domain-containing peptide sequence
KRHIGIENPHH

SEQ ID NO: 8382 - protein, 11 aa, Artificial
  IGFBP-2 heparin binding domain-containing peptide sequence
RRHIGIENPHH

SEQ ID NO: 8383 - protein, 11 aa, Artificial
  IGFBP-2 heparin binding domain-containing peptide sequence
HRHIGIENPHH

SEQ ID NO: 8384 - protein, 11 aa, Artificial
  IGFBP-2 heparin binding domain-containing peptide sequence
KHKIGIENPHH

SEQ ID NO: 8385 - protein, 11 aa, Artificial
  IGFBP-2 heparin binding domain-containing peptide sequence
RHKIGIENPHH

SEQ ID NO: 8386 - protein, 11 aa, Artificial
  IGFBP-2 heparin binding domain-containing peptide sequence
HHKIGIENPHH

SEQ ID NO: 8387 - protein, 11 aa, Artificial
  IGFBP-2 heparin binding domain-containing peptide sequence
KKKIGIENPHH

SEQ ID NO: 8388 - protein, 11 aa, Artificial
  IGFBP-2 heparin binding domain-containing peptide sequence
RKKIGIENPHH

SEQ ID NO: 8389 - protein, 11 aa, Artificial
  IGFBP-2 heparin binding domain-containing peptide sequence
HKKIGIENPHH

SEQ ID NO: 8390 - protein, 11 aa, Artificial
  IGFBP-2 heparin binding domain-containing peptide sequence
KRKIGIENPHH

SEQ ID NO: 8391 - protein, 11 aa, Artificial
  IGFBP-2 heparin binding domain-containing peptide sequence
RRKIGIENPHH

SEQ ID NO: 8392 - protein, 11 aa, Artificial
  IGFBP-2 heparin binding domain-containing peptide sequence
HRKIGIENPHH

SEQ ID NO: 8393 - protein, 11 aa, Artificial
  IGFBP-2 heparin binding domain-containing peptide sequence
KHRIGIENPHH

SEQ ID NO: 8394 - protein, 11 aa, Artificial
  IGFBP-2 heparin binding domain-containing peptide sequence
RHRIGIENPHH

SEQ ID NO: 8395 - protein, 11 aa, Artificial
  IGFBP-2 heparin binding domain-containing peptide sequence
HHRIGIENPHH

SEQ ID NO: 8396 - protein, 11 aa, Artificial
  IGFBP-2 heparin binding domain-containing peptide sequence
KKRIGIENPHH

SEQ ID NO: 8397 - protein, 11 aa, Artificial
  IGFBP-2 heparin binding domain-containing peptide sequence
RKRIGIENPHH

SEQ ID NO: 8398 - protein, 11 aa, Artificial
  IGFBP-2 heparin binding domain-containing peptide sequence
HKRIGIENPHH

SEQ ID NO: 8399 - protein, 11 aa, Artificial
  IGFBP-2 heparin binding domain-containing peptide sequence
KRRIGIENPHH

SEQ ID NO: 8400 - protein, 11 aa, Artificial
  IGFBP-2 heparin binding domain-containing peptide sequence
RRRIGIENPHH

SEQ ID NO: 8401 - protein, 11 aa, Artificial
  IGFBP-2 heparin binding domain-containing peptide sequence
HRRIGIENPHH

SEQ ID NO: 8402 - protein, 11 aa, Artificial
  IGFBP-2 heparin binding domain-containing peptide sequence
KHHVGIENPHH

SEQ ID NO: 8403 - protein, 11 aa, Artificial
  IGFBP-2 heparin binding domain-containing peptide sequence
RHHVGIENPHH

SEQ ID NO: 8404 - protein, 11 aa, Artificial
  IGFBP-2 heparin binding domain-containing peptide sequence
HHHVGIENPHH

SEQ ID NO: 8405 - protein, 11 aa, Artificial
  IGFBP-2 heparin binding domain-containing peptide sequence
KKHVGIENPHH

SEQ ID NO: 8406 - protein, 11 aa, Artificial
  IGFBP-2 heparin binding domain-containing peptide sequence
RKHVGIENPHH

SEQ ID NO: 8407 - protein, 11 aa, Artificial
  IGFBP-2 heparin binding domain-containing peptide sequence
HKHVGIENPHH

SEQ ID NO: 8408 - protein, 11 aa, Artificial
  IGFBP-2 heparin binding domain-containing peptide sequence
KRHVGIENPHH

SEQ ID NO: 8409 - protein, 11 aa, Artificial
  IGFBP-2 heparin binding domain-containing peptide sequence
RRHVGIENPHH

SEQ ID NO: 8410 - protein, 11 aa, Artificial
  IGFBP-2 heparin binding domain-containing peptide sequence
HRHVGIENPHH

SEQ ID NO: 8411 - protein, 11 aa, Artificial
  IGFBP-2 heparin binding domain-containing peptide sequence
KHKVGIENPHH

SEQ ID NO: 8412 - protein, 11 aa, Artificial
  IGFBP-2 heparin binding domain-containing peptide sequence
RHKVGIENPHH

SEQ ID NO: 8413 - protein, 11 aa, Artificial
  IGFBP-2 heparin binding domain-containing peptide sequence
HHKVGIENPHH

SEQ ID NO: 8414 - protein, 11 aa, Artificial
  IGFBP-2 heparin binding domain-containing peptide sequence
KKKVGIENPHH

SEQ ID NO: 8415 - protein, 11 aa, Artificial
  IGFBP-2 heparin binding domain-containing peptide sequence
RKKVGIENPHH

SEQ ID NO: 8416 - protein, 11 aa, Artificial
  IGFBP-2 heparin binding domain-containing peptide sequence
HKKVGIENPHH

SEQ ID NO: 8417 - protein, 11 aa, Artificial
  IGFBP-2 heparin binding domain-containing peptide sequence
KRKVGIENPHH

SEQ ID NO: 8418 - protein, 11 aa, Artificial
  IGFBP-2 heparin binding domain-containing peptide sequence
RRKVGIENPHH

SEQ ID NO: 8419 - protein, 11 aa, Artificial
  IGFBP-2 heparin binding domain-containing peptide sequence
HRKVGIENPHH

SEQ ID NO: 8420 - protein, 11 aa, Artificial
  IGFBP-2 heparin binding domain-containing peptide sequence
KHRVGIENPHH

SEQ ID NO: 8421 - protein, 11 aa, Artificial
  IGFBP-2 heparin binding domain-containing peptide sequence
RHRVGIENPHH

SEQ ID NO: 8422 - protein, 11 aa, Artificial
  IGFBP-2 heparin binding domain-containing peptide sequence
HHRVGIENPHH

SEQ ID NO: 8423 - protein, 11 aa, Artificial
  IGFBP-2 heparin binding domain-containing peptide sequence
KKRVGIENPHH

SEQ ID NO: 8424 - protein, 11 aa, Artificial
  IGFBP-2 heparin binding domain-containing peptide sequence
RKRVGIENPHH

SEQ ID NO: 8425 - protein, 11 aa, Artificial
  IGFBP-2 heparin binding domain-containing peptide sequence
HKRVGIENPHH

SEQ ID NO: 8426 - protein, 11 aa, Artificial
  IGFBP-2 heparin binding domain-containing peptide sequence
KRRVGIENPHH

SEQ ID NO: 8427 - protein, 11 aa, Artificial
  IGFBP-2 heparin binding domain-containing peptide sequence
RRRVGIENPHH

SEQ ID NO: 8428 - protein, 11 aa, Artificial
  IGFBP-2 heparin binding domain-containing peptide sequence
HRRVGIENPHH

SEQ ID NO: 8429 - protein, 11 aa, Artificial
  IGFBP-2 heparin binding domain-containing peptide sequence
KHHLGVENPHH

SEQ ID NO: 8430 - protein, 11 aa, Artificial
  IGFBP-2 heparin binding domain-containing peptide sequence
RHHLGVENPHH

SEQ ID NO: 8431 - protein, 11 aa, Artificial
  IGFBP-2 heparin binding domain-containing peptide sequence
HHHLGVENPHH

SEQ ID NO: 8432 - protein, 11 aa, Artificial
  IGFBP-2 heparin binding domain-containing peptide sequence
KKHLGVENPHH

SEQ ID NO: 8433 - protein, 11 aa, Artificial
  IGFBP-2 heparin binding domain-containing peptide sequence
RKHLGVENPHH

SEQ ID NO: 8434 - protein, 11 aa, Artificial
  IGFBP-2 heparin binding domain-containing peptide sequence
HKHLGVENPHH

SEQ ID NO: 8435 - protein, 11 aa, Artificial
  IGFBP-2 heparin binding domain-containing peptide sequence
KRHLGVENPHH

SEQ ID NO: 8436 - protein, 11 aa, Artificial
  IGFBP-2 heparin binding domain-containing peptide sequence
RRHLGVENPHH

SEQ ID NO: 8437 - protein, 11 aa, Artificial
  IGFBP-2 heparin binding domain-containing peptide sequence
HRHLGVENPHH

SEQ ID NO: 8438 - protein, 11 aa, Artificial
  IGFBP-2 heparin binding domain-containing peptide sequence
KHKLGVENPHH

SEQ ID NO: 8439 - protein, 11 aa, Artificial
  IGFBP-2 heparin binding domain-containing peptide sequence
RHKLGVENPHH

SEQ ID NO: 8440 - protein, 11 aa, Artificial
  IGFBP-2 heparin binding domain-containing peptide sequence
HHKLGVENPHH

SEQ ID NO: 8441 - protein, 11 aa, Artificial
  IGFBP-2 heparin binding domain-containing peptide sequence
KKKLGVENPHH

SEQ ID NO: 8442 - protein, 11 aa, Artificial
  IGFBP-2 heparin binding domain-containing peptide sequence
RKKLGVENPHH

SEQ ID NO: 8443 - protein, 11 aa, Artificial
  IGFBP-2 heparin binding domain-containing peptide sequence
HKKLGVENPHH

SEQ ID NO: 8444 - protein, 11 aa, Artificial
  IGFBP-2 heparin binding domain-containing peptide sequence
KRKLGVENPHH

SEQ ID NO: 8445 - protein, 11 aa, Artificial
  IGFBP-2 heparin binding domain-containing peptide sequence
RRKLGVENPHH

SEQ ID NO: 8446 - protein, 11 aa, Artificial
  IGFBP-2 heparin binding domain-containing peptide sequence
HRKLGVENPHH

SEQ ID NO: 8447 - protein, 11 aa, Artificial
  IGFBP-2 heparin binding domain-containing peptide sequence
KHRLGVENPHH

SEQ ID NO: 8448 - protein, 11 aa, Artificial
  IGFBP-2 heparin binding domain-containing peptide sequence
RHRLGVENPHH

SEQ ID NO: 8449 - protein, 11 aa, Artificial
  IGFBP-2 heparin binding domain-containing peptide sequence
HHRLGVENPHH

SEQ ID NO: 8450 - protein, 11 aa, Artificial
  IGFBP-2 heparin binding domain-containing peptide sequence
KKRLGVENPHH

SEQ ID NO: 8451 - protein, 11 aa, Artificial
  IGFBP-2 heparin binding domain-containing peptide sequence
RKRLGVENPHH

SEQ ID NO: 8452 - protein, 11 aa, Artificial
  IGFBP-2 heparin binding domain-containing peptide sequence
HKRLGVENPHH

SEQ ID NO: 8453 - protein, 11 aa, Artificial
  IGFBP-2 heparin binding domain-containing peptide sequence
KRRLGVENPHH

SEQ ID NO: 8454 - protein, 11 aa, Artificial
  IGFBP-2 heparin binding domain-containing peptide sequence
RRRLGVENPHH

SEQ ID NO: 8455 - protein, 11 aa, Artificial
  IGFBP-2 heparin binding domain-containing peptide sequence
HRRLGVENPHH

SEQ ID NO: 8456 - protein, 11 aa, Artificial
  IGFBP-2 heparin binding domain-containing peptide sequence
KHHIGVENPHH

SEQ ID NO: 8457 - protein, 11 aa, Artificial
  IGFBP-2 heparin binding domain-containing peptide sequence
RHHIGVEEPHH

SEQ ID NO: 8458 - protein, 11 aa, Artificial
  IGFBP-2 heparin binding domain-containing peptide sequence
HHHIGVENPHH

SEQ ID NO: 8459 - protein, 11 aa, Artificial
  IGFBP-2 heparin binding domain-containing peptide sequence
KKHIGVENPHH

SEQ ID NO: 8460 - protein, 11 aa, Artificial
  IGFBP-2 heparin binding domain-containing peptide sequence
RKHIGVENPHH

SEQ ID NO: 8461 - protein, 11 aa, Artificial
  IGFBP-2 heparin binding domain-containing peptide sequence
HKHIGVENPHH

SEQ ID NO: 8462 - protein, 11 aa, Artificial
  IGFBP-2 heparin binding domain-containing peptide sequence
KRHIGVENPHH

SEQ ID NO: 8463 - protein, 11 aa, Artificial
  IGFBP-2 heparin binding domain-containing peptide sequence
RRHIGVENPHH

SEQ ID NO: 8464 - protein, 11 aa, Artificial
  IGFBP-2 heparin binding domain-containing peptide sequence
HRHIGVENPHH

SEQ ID NO: 8465 - protein, 11 aa, Artificial
  IGFBP-2 heparin binding domain-containing peptide sequence
KHKIGVENPHH

SEQ ID NO: 8466 - protein, 11 aa, Artificial
  IGFBP-2 heparin binding domain-containing peptide sequence
RHKIGVENPHH

SEQ ID NO: 8467 - protein, 11 aa, Artificial
  IGFBP-2 heparin binding domain-containing peptide sequence
HHKIGVENPHH

SEQ ID NO: 8468 - protein, 11 aa, Artificial
  IGFBP-2 heparin binding domain-containing peptide sequence
KKKIGVENPHH

SEQ ID NO: 8469 - protein, 11 aa, Artificial
  IGFBP-2 heparin binding domain-containing peptide sequence
RKKIGVENPHH

SEQ ID NO: 8470 - protein, 11 aa, Artificial
  IGFBP-2 heparin binding domain-containing peptide sequence
HKKIGVENPHH

SEQ ID NO: 8471 - protein, 11 aa, Artificial
  IGFBP-2 heparin binding domain-containing peptide sequence
KRKIGVENPHH

SEQ ID NO: 8472 - protein, 11 aa, Artificial
  IGFBP-2 heparin binding domain-containing peptide sequence
RRKIGVENPHH

SEQ ID NO: 8473 - protein, 11 aa, Artificial
  IGFBP-2 heparin binding domain-containing peptide sequence
HRKIGVENPHH

SEQ ID NO: 8474 - protein, 11 aa, Artificial
  IGFBP-2 heparin binding domain-containing peptide sequence
KHRIGVENPHH

SEQ ID NO: 8475 - protein, 11 aa, Artificial
  IGFBP-2 heparin binding domain-containing peptide sequence
RHRIGVENPHH

SEQ ID NO: 8476 - protein, 11 aa, Artificial
  IGFBP-2 heparin binding domain-containing peptide sequence
HHRIGVENPHH

SEQ ID NO: 8477 - protein, 11 aa, Artificial
  IGFBP-2 heparin binding domain-containing peptide sequence
KKRIGVENPHH

SEQ ID NO: 8478 - protein, 11 aa, Artificial
  IGFBP-2 heparin binding domain-containing peptide sequence
RKRIGVENPHH

SEQ ID NO: 8479 - protein, 11 aa, Artificial
  IGFBP-2 heparin binding domain-containing peptide sequence
HKRIGVENPHH

SEQ ID NO: 8480 - protein, 11 aa, Artificial
  IGFBP-2 heparin binding domain-containing peptide sequence
KRRIGVENPHH

SEQ ID NO: 8481 - protein, 11 aa, Artificial
  IGFBP-2 heparin binding domain-containing peptide sequence
RRRIGVENPHH

SEQ ID NO: 8482 - protein, 11 aa, Artificial
  IGFBP-2 heparin binding domain-containing peptide sequence
HRRIGVENPHH

SEQ ID NO: 8483 - protein, 11 aa, Artificial
  IGFBP-2 heparin binding domain-containing peptide sequence
KHHVGVENPHH

SEQ ID NO: 8484 - protein, 11 aa, Artificial
  IGFBP-2 heparin binding domain-containing peptide sequence
RHHVGVENPHH

SEQ ID NO: 8485 - protein, 11 aa, Artificial
  IGFBP-2 heparin binding domain-containing peptide sequence
HHHVGVENPHH

SEQ ID NO: 8486 - protein, 11 aa, Artificial
  IGFBP-2 heparin binding domain-containing peptide sequence
KKHVGVENPHH

SEQ ID NO: 8487 - protein, 11 aa, Artificial
  IGFBP-2 heparin binding domain-containing peptide sequence
RKHVGVENPHH

SEQ ID NO: 8488 - protein, 11 aa, Artificial
  IGFBP-2 heparin binding domain-containing peptide sequence
HKHVGVENPHH

SEQ ID NO: 8489 - protein, 11 aa, Artificial
  IGFBP-2 heparin binding domain-containing peptide sequence
KRHVGVENPHH

SEQ ID NO: 8490 - protein, 11 aa, Artificial
  IGFBP-2 heparin binding domain-containing peptide sequence
RRHVGVENPHH

SEQ ID NO: 8491 - protein, 11 aa, Artificial
  IGFBP-2 heparin binding domain-containing peptide sequence
HRHVGVENPHH

SEQ ID NO: 8492 - protein, 11 aa, Artificial
  IGFBP-2 heparin binding domain-containing peptide sequence
KHKVGVENPHH

SEQ ID NO: 8493 - protein, 11 aa, Artificial
  IGFBP-2 heparin binding domain-containing peptide sequence
RHKVGVENPHH

SEQ ID NO: 8494 - protein, 11 aa, Artificial
  IGFBP-2 heparin binding domain-containing peptide sequence
HHKVGVENPHH

SEQ ID NO: 8495 - protein, 11 aa, Artificial
  IGFBP-2 heparin binding domain-containing peptide sequence
KKKVGVENPHH

SEQ ID NO: 8496 - protein, 11 aa, Artificial
  IGFBP-2 heparin binding domain-containing peptide sequence
RKKVGVENPHH

SEQ ID NO: 8497 - protein, 11 aa, Artificial
  IGFBP-2 heparin binding domain-containing peptide sequence
HKKVGVENPHH

SEQ ID NO: 8498 - protein, 11 aa, Artificial
  IGFBP-2 heparin binding domain-containing peptide sequence
KRKVGVENPHH

SEQ ID NO: 8499 - protein, 11 aa, Artificial
  IGFBP-2 heparin binding domain-containing peptide sequence
RRKVGVEEPHH

SEQ ID NO: 8500 - protein, 11 aa, Artificial
  IGFBP-2 heparin binding domain-containing peptide sequence
HRKVGVENPHH

SEQ ID NO: 8501 - protein, 11 aa, Artificial
  IGFBP-2 heparin binding domain-containing peptide sequence
KHRVGVENPHH

SEQ ID NO: 8502 - protein, 11 aa, Artificial
  IGFBP-2 heparin binding domain-containing peptide sequence
RHRVGVENPHH

SEQ ID NO: 8503 - protein, 11 aa, Artificial
  IGFBP-2 heparin binding domain-containing peptide sequence
HHRVGVENPHH

SEQ ID NO: 8504 - protein, 11 aa, Artificial
  IGFBP-2 heparin binding domain-containing peptide sequence
KKRVGVENPHH

SEQ ID NO: 8505 - protein, 11 aa, Artificial
  IGFBP-2 heparin binding domain-containing peptide sequence
RKRVGVENPHH

SEQ ID NO: 8506 - protein, 11 aa, Artificial
  IGFBP-2 heparin binding domain-containing peptide sequence
HKRVGVENPHH

SEQ ID NO: 8507 - protein, 11 aa, Artificial
  IGFBP-2 heparin binding domain-containing peptide sequence
KRRVGVENPHH

SEQ ID NO: 8508 - protein, 11 aa, Artificial
  IGFBP-2 heparin binding domain-containing peptide sequence
RRRVGVENPHH

SEQ ID NO: 8509 - protein, 11 aa, Artificial
  IGFBP-2 heparin binding domain-containing peptide sequence
HRRVGVENPHH

SEQ ID NO: 8510 - protein, 11 aa, Artificial
  IGFBP-2 heparin binding domain-containing peptide sequence
KHHLGLNNPHH

SEQ ID NO: 8511 - protein, 11 aa, Artificial
  IGFBP-2 heparin binding domain-containing peptide sequence
RHHLGLNNPHH

SEQ ID NO: 8512 - protein, 11 aa, Artificial
  IGFBP-2 heparin binding domain-containing peptide sequence
HHHLGLNNPHH

SEQ ID NO: 8513 - protein, 11 aa, Artificial
  IGFBP-2 heparin binding domain-containing peptide sequence
KKHLGLNNPHH

SEQ ID NO: 8514 - protein, 11 aa, Artificial
  IGFBP-2 heparin binding domain-containing peptide sequence
RKHLGLNNPHH

SEQ ID NO: 8515 - protein, 11 aa, Artificial
  IGFBP-2 heparin binding domain-containing peptide sequence
HKHLGLNNPHH

SEQ ID NO: 8516 - protein, 11 aa, Artificial
  IGFBP-2 heparin binding domain-containing peptide sequence
KRHLGLNNPHH

SEQ ID NO: 8517 - protein, 11 aa, Artificial
  IGFBP-2 heparin binding domain-containing peptide sequence
RRHLGLNNPHH

SEQ ID NO: 8518 - protein, 11 aa, Artificial
  IGFBP-2 heparin binding domain-containing peptide sequence
HRHLGLNNPHH

SEQ ID NO: 8519 - protein, 11 aa, Artificial
  IGFBP-2 heparin binding domain-containing peptide sequence
KHKLGLNNPHH

SEQ ID NO: 8520 - protein, 11 aa, Artificial
  IGFBP-2 heparin binding domain-containing peptide sequence
RHKLGLNNPHH

SEQ ID NO: 8521 - protein, 11 aa, Artificial
  IGFBP-2 heparin binding domain-containing peptide sequence
HHKLGLNNPHH

SEQ ID NO: 8522 - protein, 11 aa, Artificial
  IGFBP-2 heparin binding domain-containing peptide sequence
KKKLGLNNPHH

SEQ ID NO: 8523 - protein, 11 aa, Artificial
  IGFBP-2 heparin binding domain-containing peptide sequence
RKKLGLNNPHH

SEQ ID NO: 8524 - protein, 11 aa, Artificial
  IGFBP-2 heparin binding domain-containing peptide sequence
HKKLGLNNPHH

SEQ ID NO: 8525 - protein, 11 aa, Artificial
  IGFBP-2 heparin binding domain-containing peptide sequence
KRKLGLNNPHH

SEQ ID NO: 8526 - protein, 11 aa, Artificial
  IGFBP-2 heparin binding domain-containing peptide sequence
RRKLGLNNPHH

SEQ ID NO: 8527 - protein, 11 aa, Artificial
  IGFBP-2 heparin binding domain-containing peptide sequence
HRKLGLNNPHH

SEQ ID NO: 8528 - protein, 11 aa, Artificial
  IGFBP-2 heparin binding domain-containing peptide sequence
KHRLGLNNPHH

SEQ ID NO: 8529 - protein, 11 aa, Artificial
  IGFBP-2 heparin binding domain-containing peptide sequence
RHRLGLNNPHH

SEQ ID NO: 8530 - protein, 11 aa, Artificial
  IGFBP-2 heparin binding domain-containing peptide sequence
HHRLGLNNPHH

SEQ ID NO: 8531 - protein, 11 aa, Artificial
  IGFBP-2 heparin binding domain-containing peptide sequence
KKRLGLNNPHH

SEQ ID NO: 8532 - protein, 11 aa, Artificial
  IGFBP-2 heparin binding domain-containing peptide sequence
RKRLGLNNPHH

SEQ ID NO: 8533 - protein, 11 aa, Artificial
  IGFBP-2 heparin binding domain-containing peptide sequence
HKRLGLNNPHH

SEQ ID NO: 8534 - protein, 11 aa, Artificial
  IGFBP-2 heparin binding domain-containing peptide sequence
KRRLGLNNPHH

SEQ ID NO: 8535 - protein, 11 aa, Artificial
  IGFBP-2 heparin binding domain-containing peptide sequence
RRRLGLNNPHH

SEQ ID NO: 8536 - protein, 11 aa, Artificial
  IGFBP-2 heparin binding domain-containing peptide sequence
HRRLGLNNPHH

SEQ ID NO: 8537 - protein, 11 aa, Artificial
  IGFBP-2 heparin binding domain-containing peptide sequence
KHHIGLNNPHH

SEQ ID NO: 8538 - protein, 11 aa, Artificial
  IGFBP-2 heparin binding domain-containing peptide sequence
RHHIGLNNPHH

SEQ ID NO: 8539 - protein, 11 aa, Artificial
  IGFBP-2 heparin binding domain-containing peptide sequence
HHHIGLNNPHH

SEQ ID NO: 8540 - protein, 11 aa, Artificial
  IGFBP-2 heparin binding domain-containing peptide sequence
KKHIGLNNPHH

SEQ ID NO: 8541 - protein, 11 aa, Artificial
  IGFBP-2 heparin binding domain-containing peptide sequence
RKHIGLNNPHH

SEQ ID NO: 8542 - protein, 11 aa, Artificial
  IGFBP-2 heparin binding domain-containing peptide sequence
HKHIGLNNPHH

SEQ ID NO: 8543 - protein, 11 aa, Artificial
  IGFBP-2 heparin binding domain-containing peptide sequence
KRHIGLNNPHH

SEQ ID NO: 8544 - protein, 11 aa, Artificial
  IGFBP-2 heparin binding domain-containing peptide sequence
RRHIGLNNPHH

SEQ ID NO: 8545 - protein, 11 aa, Artificial
  IGFBP-2 heparin binding domain-containing peptide sequence
HRHIGLNNPHH

SEQ ID NO: 8546 - protein, 11 aa, Artificial
  IGFBP-2 heparin binding domain-containing peptide sequence
KHKIGLNNPHH

SEQ ID NO: 8547 - protein, 11 aa, Artificial
  IGFBP-2 heparin binding domain-containing peptide sequence
RHKIGLNNPHH

SEQ ID NO: 8548 - protein, 11 aa, Artificial
  IGFBP-2 heparin binding domain-containing peptide sequence
HHKIGLNNPHH

SEQ ID NO: 8549 - protein, 11 aa, Artificial
  IGFBP-2 heparin binding domain-containing peptide sequence
KKKIGLNNPHH

SEQ ID NO: 8550 - protein, 11 aa, Artificial
  IGFBP-2 heparin binding domain-containing peptide sequence
RKKIGLNNPHH

SEQ ID NO: 8551 - protein, 11 aa, Artificial
  IGFBP-2 heparin binding domain-containing peptide sequence
HKKIGLNNPHH

SEQ ID NO: 8552 - protein, 11 aa, Artificial
  IGFBP-2 heparin binding domain-containing peptide sequence
KRKIGLNNPHH

SEQ ID NO: 8553 - protein, 11 aa, Artificial
  IGFBP-2 heparin binding domain-containing peptide sequence
RRKIGLNNPHH

SEQ ID NO: 8554 - protein, 11 aa, Artificial
  IGFBP-2 heparin binding domain-containing peptide sequence
HRKIGLNNPHH

SEQ ID NO: 8555 - protein, 11 aa, Artificial
  IGFBP-2 heparin binding domain-containing peptide sequence
KHRIGLNNPHH

SEQ ID NO: 8556 - protein, 11 aa, Artificial
  IGFBP-2 heparin binding domain-containing peptide sequence
RHRIGLNNPHH

SEQ ID NO: 8557 - protein, 11 aa, Artificial
  IGFBP-2 heparin binding domain-containing peptide sequence
HHRIGLNNPHH

SEQ ID NO: 8558 - protein, 11 aa, Artificial
  IGFBP-2 heparin binding domain-containing peptide sequence
KKRIGLNNPHH

SEQ ID NO: 8559 - protein, 11 aa, Artificial
  IGFBP-2 heparin binding domain-containing peptide sequence
RKRIGLNNPHH

SEQ ID NO: 8560 - protein, 11 aa, Artificial
  IGFBP-2 heparin binding domain-containing peptide sequence
HKRIGLNNPHH

SEQ ID NO: 8561 - protein, 11 aa, Artificial
  IGFBP-2 heparin binding domain-containing peptide sequence
KRRIGLNNPHH

SEQ ID NO: 8562 - protein, 11 aa, Artificial
  IGFBP-2 heparin binding domain-containing peptide sequence
RRRIGLNNPHH

SEQ ID NO: 8563 - protein, 11 aa, Artificial
  IGFBP-2 heparin binding domain-containing peptide sequence
HRRIGLNNPHH

SEQ ID NO: 8564 - protein, 11 aa, Artificial
  IGFBP-2 heparin binding domain-containing peptide sequence
KHHVGLNNPHH

SEQ ID NO: 8565 - protein, 11 aa, Artificial
  IGFBP-2 heparin binding domain-containing peptide sequence
RHHVGLNNPHH

SEQ ID NO: 8566 - protein, 11 aa, Artificial
  IGFBP-2 heparin binding domain-containing peptide sequence
HHHVGLNNPHH

SEQ ID NO: 8567 - protein, 11 aa, Artificial
  IGFBP-2 heparin binding domain-containing peptide sequence
KKHVGLNNPHH

SEQ ID NO: 8568 - protein, 11 aa, Artificial
  IGFBP-2 heparin binding domain-containing peptide sequence
RKHVGLNNPHH

SEQ ID NO: 8569 - protein, 11 aa, Artificial
  IGFBP-2 heparin binding domain-containing peptide sequence
HKHVGLNNPHH

SEQ ID NO: 8570 - protein, 11 aa, Artificial
  IGFBP-2 heparin binding domain-containing peptide sequence
KRHVGLNNPHH

SEQ ID NO: 8571 - protein, 11 aa, Artificial
  IGFBP-2 heparin binding domain-containing peptide sequence
RRHVGLNNPHH

SEQ ID NO: 8572 - protein, 11 aa, Artificial
  IGFBP-2 heparin binding domain-containing peptide sequence
HRHVGLNNPHH

SEQ ID NO: 8573 - protein, 11 aa, Artificial
  IGFBP-2 heparin binding domain-containing peptide sequence
KHKVGLNNPHH

SEQ ID NO: 8574 - protein, 11 aa, Artificial
  IGFBP-2 heparin binding domain-containing peptide sequence
RHKVGLNNPHH

SEQ ID NO: 8575 - protein, 11 aa, Artificial
  IGFBP-2 heparin binding domain-containing peptide sequence
HHKVGLNNPHH

SEQ ID NO: 8576 - protein, 11 aa, Artificial
  IGFBP-2 heparin binding domain-containing peptide sequence
KKKVGLNNPHH

SEQ ID NO: 8577 - protein, 11 aa, Artificial
  IGFBP-2 heparin binding domain-containing peptide sequence
RKKVGLNNPHH

SEQ ID NO: 8578 - protein, 11 aa, Artificial
  IGFBP-2 heparin binding domain-containing peptide sequence
HKKVGLNNPHH

SEQ ID NO: 8579 - protein, 11 aa, Artificial
  IGFBP-2 heparin binding domain-containing peptide sequence
KRKVGLNNPHH

SEQ ID NO: 8580 - protein, 11 aa, Artificial
  IGFBP-2 heparin binding domain-containing peptide sequence
RRKVGLNNPHH

SEQ ID NO: 8581 - protein, 11 aa, Artificial
  IGFBP-2 heparin binding domain-containing peptide sequence
HRKVGLNNPHH

SEQ ID NO: 8582 - protein, 11 aa, Artificial
  IGFBP-2 heparin binding domain-containing peptide sequence
KHRVGLNNPHH

SEQ ID NO: 8583 - protein, 11 aa, Artificial
  IGFBP-2 heparin binding domain-containing peptide sequence
RHRVGLNNPHH

SEQ ID NO: 8584 - protein, 11 aa, Artificial
  IGFBP-2 heparin binding domain-containing peptide sequence
HHRVGLNNPHH

SEQ ID NO: 8585 - protein, 11 aa, Artificial
  IGFBP-2 heparin binding domain-containing peptide sequence
KKRVGLNNPHH

SEQ ID NO: 8586 - protein, 11 aa, Artificial
  IGFBP-2 heparin binding domain-containing peptide sequence
RKRVGLNNPHH

SEQ ID NO: 8587 - protein, 11 aa, Artificial
  IGFBP-2 heparin binding domain-containing peptide sequence
HKRVGLNNPHH

SEQ ID NO: 8588 - protein, 11 aa, Artificial
  IGFBP-2 heparin binding domain-containing peptide sequence
KRRVGLNNPHH

SEQ ID NO: 8589 - protein, 11 aa, Artificial
  IGFBP-2 heparin binding domain-containing peptide sequence
RRRVGLNNPHH

SEQ ID NO: 8590 - protein, 11 aa, Artificial
  IGFBP-2 heparin binding domain-containing peptide sequence
HRRVGLNNPHH

SEQ ID NO: 8591 - protein, 11 aa, Artificial
  IGFBP-2 heparin binding domain-containing peptide sequence
KHHLGINNPHH

SEQ ID NO: 8592 - protein, 11 aa, Artificial
  IGFBP-2 heparin binding domain-containing peptide sequence
RHHLGINNPHH

SEQ ID NO: 8593 - protein, 11 aa, Artificial
  IGFBP-2 heparin binding domain-containing peptide sequence
HHHLGINNPHH

SEQ ID NO: 8594 - protein, 11 aa, Artificial
  IGFBP-2 heparin binding domain-containing peptide sequence
KKHLGINNPHH

SEQ ID NO: 8595 - protein, 11 aa, Artificial
  IGFBP-2 heparin binding domain-containing peptide sequence
RKHLGINNPHH

SEQ ID NO: 8596 - protein, 11 aa, Artificial
  IGFBP-2 heparin binding domain-containing peptide sequence
HKHLGINNPHH

SEQ ID NO: 8597 - protein, 11 aa, Artificial
  IGFBP-2 heparin binding domain-containing peptide sequence
KRHLGINNPHH

SEQ ID NO: 8598 - protein, 11 aa, Artificial
  IGFBP-2 heparin binding domain-containing peptide sequence
RRHLGINNPHH

SEQ ID NO: 8599 - protein, 11 aa, Artificial
  IGFBP-2 heparin binding domain-containing peptide sequence
HRHLGINNPHH

SEQ ID NO: 8600 - protein, 11 aa, Artificial
  IGFBP-2 heparin binding domain-containing peptide sequence
KHKLGINNPHH

SEQ ID NO: 8601 - protein, 11 aa, Artificial
  IGFBP-2 heparin binding domain-containing peptide sequence
RHKLGINNPHH

SEQ ID NO: 8602 - protein, 11 aa, Artificial
  IGFBP-2 heparin binding domain-containing peptide sequence
HHKLGINNPHH

SEQ ID NO: 8603 - protein, 11 aa, Artificial
  IGFBP-2 heparin binding domain-containing peptide sequence
KKKLGINNPHH

SEQ ID NO: 8604 - protein, 11 aa, Artificial
  IGFBP-2 heparin binding domain-containing peptide sequence
RKKLGINNPHH

SEQ ID NO: 8605 - protein, 11 aa, Artificial
  IGFBP-2 heparin binding domain-containing peptide sequence
HKKLGINNPHH

SEQ ID NO: 8606 - protein, 11 aa, Artificial
  IGFBP-2 heparin binding domain-containing peptide sequence
KRKLGINNPHH

SEQ ID NO: 8607 - protein, 11 aa, Artificial
  IGFBP-2 heparin binding domain-containing peptide sequence
RRKLGINNPHH

SEQ ID NO: 8608 - protein, 11 aa, Artificial
  IGFBP-2 heparin binding domain-containing peptide sequence
HRKLGINNPHH

SEQ ID NO: 8609 - protein, 11 aa, Artificial
  IGFBP-2 heparin binding domain-containing peptide sequence
KHRLGINNPHH

SEQ ID NO: 8610 - protein, 11 aa, Artificial
  IGFBP-2 heparin binding domain-containing peptide sequence
RHRLGINNPHH

SEQ ID NO: 8611 - protein, 11 aa, Artificial
  IGFBP-2 heparin binding domain-containing peptide sequence
HHRLGINNPHH

SEQ ID NO: 8612 - protein, 11 aa, Artificial
  IGFBP-2 heparin binding domain-containing peptide sequence
KKRLGINNPHH

SEQ ID NO: 8613 - protein, 11 aa, Artificial
  IGFBP-2 heparin binding domain-containing peptide sequence
RKRLGINNPHH

SEQ ID NO: 8614 - protein, 11 aa, Artificial
  IGFBP-2 heparin binding domain-containing peptide sequence
HKRLGINNPHH

SEQ ID NO: 8615 - protein, 11 aa, Artificial
  IGFBP-2 heparin binding domain-containing peptide sequence
KRRLGINNPHH

SEQ ID NO: 8616 - protein, 11 aa, Artificial
  IGFBP-2 heparin binding domain-containing peptide sequence
RRRLGINNPHH

SEQ ID NO: 8617 - protein, 11 aa, Artificial
  IGFBP-2 heparin binding domain-containing peptide sequence
HRRLGINNPHH

SEQ ID NO: 8618 - protein, 11 aa, Artificial
  IGFBP-2 heparin binding domain-containing peptide sequence
KHHIGIENPHH

SEQ ID NO: 8619 - protein, 11 aa, Artificial
  IGFBP-2 heparin binding domain-containing peptide sequence
RHHIGINNPHH

SEQ ID NO: 8620 - protein, 11 aa, Artificial
  IGFBP-2 heparin binding domain-containing peptide sequence
HHHIGINNPHH

SEQ ID NO: 8621 - protein, 11 aa, Artificial
  IGFBP-2 heparin binding domain-containing peptide sequence
KKHIGINNPHH

SEQ ID NO: 8622 - protein, 11 aa, Artificial
  IGFBP-2 heparin binding domain-containing peptide sequence
RKHIGINNPHH

SEQ ID NO: 8623 - protein, 11 aa, Artificial
  IGFBP-2 heparin binding domain-containing peptide sequence
HKHIGINNPHH

SEQ ID NO: 8624 - protein, 11 aa, Artificial
  IGFBP-2 heparin binding domain-containing peptide sequence
KRHIGINNPHH

SEQ ID NO: 8625 - protein, 11 aa, Artificial
  IGFBP-2 heparin binding domain-containing peptide sequence
RRHIGINNPHH

SEQ ID NO: 8626 - protein, 11 aa, Artificial
  IGFBP-2 heparin binding domain-containing peptide sequence
HRHIGINNPHH

SEQ ID NO: 8627 - protein, 11 aa, Artificial
  IGFBP-2 heparin binding domain-containing peptide sequence
KHKIGINNPHH

SEQ ID NO: 8628 - protein, 11 aa, Artificial
  IGFBP-2 heparin binding domain-containing peptide sequence
RHKIGINNPHH

SEQ ID NO: 8629 - protein, 11 aa, Artificial
  IGFBP-2 heparin binding domain-containing peptide sequence
HHKIGINNPHH

SEQ ID NO: 8630 - protein, 11 aa, Artificial
  IGFBP-2 heparin binding domain-containing peptide sequence
KKKIGINNPHH

SEQ ID NO: 8631 - protein, 11 aa, Artificial
  IGFBP-2 heparin binding domain-containing peptide sequence
RKKIGINNPHH

SEQ ID NO: 8632 - protein, 11 aa, Artificial
  IGFBP-2 heparin binding domain-containing peptide sequence
HKKIGINNPHH

SEQ ID NO: 8633 - protein, 11 aa, Artificial
  IGFBP-2 heparin binding domain-containing peptide sequence
KRKIGINNPHH

SEQ ID NO: 8634 - protein, 11 aa, Artificial
  IGFBP-2 heparin binding domain-containing peptide sequence
RRKIGINNPHH

SEQ ID NO: 8635 - protein, 11 aa, Artificial
  IGFBP-2 heparin binding domain-containing peptide sequence
HRKIGINNPHH

SEQ ID NO: 8636 - protein, 11 aa, Artificial
  IGFBP-2 heparin binding domain-containing peptide sequence
KHRIGINNPHH

SEQ ID NO: 8637 - protein, 11 aa, Artificial
  IGFBP-2 heparin binding domain-containing peptide sequence
RHRIGINNPHH

SEQ ID NO: 8638 - protein, 11 aa, Artificial
  IGFBP-2 heparin binding domain-containing peptide sequence
HHRIGINNPHH

SEQ ID NO: 8639 - protein, 11 aa, Artificial
  IGFBP-2 heparin binding domain-containing peptide sequence
KKRIGINNPHH

SEQ ID NO: 8640 - protein, 11 aa, Artificial
  IGFBP-2 heparin binding domain-containing peptide sequence
RKRIGINNPHH

SEQ ID NO: 8641 - protein, 11 aa, Artificial
  IGFBP-2 heparin binding domain-containing peptide sequence
HKRIGINNPHH

SEQ ID NO: 8642 - protein, 11 aa, Artificial
  IGFBP-2 heparin binding domain-containing peptide sequence
KRRIGINNPHH

SEQ ID NO: 8643 - protein, 11 aa, Artificial
  IGFBP-2 heparin binding domain-containing peptide sequence
RRRIGINNPHH

SEQ ID NO: 8644 - protein, 11 aa, Artificial
  IGFBP-2 heparin binding domain-containing peptide sequence
HRRIGINNPHH

SEQ ID NO: 8645 - protein, 11 aa, Artificial
  IGFBP-2 heparin binding domain-containing peptide sequence
KHHVGINNPHH

SEQ ID NO: 8646 - protein, 11 aa, Artificial
  IGFBP-2 heparin binding domain-containing peptide sequence
RHHVGINNPHH

SEQ ID NO: 8647 - protein, 11 aa, Artificial
  IGFBP-2 heparin binding domain-containing peptide sequence
HHHVGINNPHH

SEQ ID NO: 8648 - protein, 11 aa, Artificial
  IGFBP-2 heparin binding domain-containing peptide sequence
KKHVGINNPHH

SEQ ID NO: 8649 - protein, 11 aa, Artificial
  IGFBP-2 heparin binding domain-containing peptide sequence
RKHVGINNPHH

SEQ ID NO: 8650 - protein, 11 aa, Artificial
  IGFBP-2 heparin binding domain-containing peptide sequence
HKHVGINNPHH

SEQ ID NO: 8651 - protein, 11 aa, Artificial
  IGFBP-2 heparin binding domain-containing peptide sequence
KRHVGINNPHH

SEQ ID NO: 8652 - protein, 11 aa, Artificial
  IGFBP-2 heparin binding domain-containing peptide sequence
RRHVGINNPHH

SEQ ID NO: 8653 - protein, 11 aa, Artificial
  IGFBP-2 heparin binding domain-containing peptide sequence
HRHVGINNPHH

SEQ ID NO: 8654 - protein, 11 aa, Artificial
  IGFBP-2 heparin binding domain-containing peptide sequence
KHKVGINNPHH

SEQ ID NO: 8655 - protein, 11 aa, Artificial
  IGFBP-2 heparin binding domain-containing peptide sequence
RHKVGINNPHH

SEQ ID NO: 8656 - protein, 11 aa, Artificial
  IGFBP-2 heparin binding domain-containing peptide sequence
HHKVGINNPHH

SEQ ID NO: 8657 - protein, 11 aa, Artificial
  IGFBP-2 heparin binding domain-containing peptide sequence
KKKVGINNPHH

SEQ ID NO: 8658 - protein, 11 aa, Artificial
  IGFBP-2 heparin binding domain-containing peptide sequence
RKKVGINNPHH

SEQ ID NO: 8659 - protein, 11 aa, Artificial
  IGFBP-2 heparin binding domain-containing peptide sequence
HKKVGINNPHH

SEQ ID NO: 8660 - protein, 11 aa, Artificial
  IGFBP-2 heparin binding domain-containing peptide sequence
KRKVGINNPHH

SEQ ID NO: 8661 - protein, 11 aa, Artificial
  IGFBP-2 heparin binding domain-containing peptide sequence
RRKVGINNPHH

SEQ ID NO: 8662 - protein, 11 aa, Artificial
  IGFBP-2 heparin binding domain-containing peptide sequence
HRKVGINNPHH

SEQ ID NO: 8663 - protein, 11 aa, Artificial
  IGFBP-2 heparin binding domain-containing peptide sequence
KHRVGINNPHH

SEQ ID NO: 8664 - protein, 11 aa, Artificial
  IGFBP-2 heparin binding domain-containing peptide sequence
RHRVGINNPHH

SEQ ID NO: 8665 - protein, 11 aa, Artificial
  IGFBP-2 heparin binding domain-containing peptide sequence
HHRVGINNPHH

SEQ ID NO: 8666 - protein, 11 aa, Artificial
  IGFBP-2 heparin binding domain-containing peptide sequence
KKRVGINNPHH

SEQ ID NO: 8667 - protein, 11 aa, Artificial
  IGFBP-2 heparin binding domain-containing peptide sequence
RKRVGINNPHH

SEQ ID NO: 8668 - protein, 11 aa, Artificial
  IGFBP-2 heparin binding domain-containing peptide sequence
HKRVGINNPHH

SEQ ID NO: 8669 - protein, 11 aa, Artificial
  IGFBP-2 heparin binding domain-containing peptide sequence
KRRVGINNPHH

SEQ ID NO: 8670 - protein, 11 aa, Artificial
  IGFBP-2 heparin binding domain-containing peptide sequence
RRRVGINNPHH

SEQ ID NO: 8671 - protein, 11 aa, Artificial
  IGFBP-2 heparin binding domain-containing peptide sequence
HRRVGINNPHH

SEQ ID NO: 8672 - protein, 11 aa, Artificial
  IGFBP-2 heparin binding domain-containing peptide sequence
KHHLGVNNPHH

SEQ ID NO: 8673 - protein, 11 aa, Artificial
  IGFBP-2 heparin binding domain-containing peptide sequence
RHHLGVNNPHH

SEQ ID NO: 8674 - protein, 11 aa, Artificial
  IGFBP-2 heparin binding domain-containing peptide sequence
HHHLGVNNPHH

SEQ ID NO: 8675 - protein, 11 aa, Artificial
  IGFBP-2 heparin binding domain-containing peptide sequence
KKHLGVNNPHH

SEQ ID NO: 8676 - protein, 11 aa, Artificial
  IGFBP-2 heparin binding domain-containing peptide sequence
RKHLGVNNPHH

SEQ ID NO: 8677 - protein, 11 aa, Artificial
  IGFBP-2 heparin binding domain-containing peptide sequence
HKHLGVNNPHH

SEQ ID NO: 8678 - protein, 11 aa, Artificial
  IGFBP-2 heparin binding domain-containing peptide sequence
KRHLGVNNPHH

SEQ ID NO: 8679 - protein, 11 aa, Artificial
  IGFBP-2 heparin binding domain-containing peptide sequence
RRHLGVNNPHH

SEQ ID NO: 8680 - protein, 11 aa, Artificial
  IGFBP-2 heparin binding domain-containing peptide sequence
HRHLGVNNPHH

SEQ ID NO: 8681 - protein, 11 aa, Artificial
  IGFBP-2 heparin binding domain-containing peptide sequence
KHKLGVNNPHH

SEQ ID NO: 8682 - protein, 11 aa, Artificial
  IGFBP-2 heparin binding domain-containing peptide sequence
RHKLGVNNPHH

SEQ ID NO: 8683 - protein, 11 aa, Artificial
  IGFBP-2 heparin binding domain-containing peptide sequence
HHKLGVNNPHH

SEQ ID NO: 8684 - protein, 11 aa, Artificial
  IGFBP-2 heparin binding domain-containing peptide sequence
KKKLGVNNPHH

SEQ ID NO: 8685 - protein, 11 aa, Artificial
  IGFBP-2 heparin binding domain-containing peptide sequence
RKKLGVNNPHH

SEQ ID NO: 8686 - protein, 11 aa, Artificial
  IGFBP-2 heparin binding domain-containing peptide sequence
HKKLGVNNPHH

SEQ ID NO: 8687 - protein, 11 aa, Artificial
  IGFBP-2 heparin binding domain-containing peptide sequence
KRKLGVNNPHH

SEQ ID NO: 8688 - protein, 11 aa, Artificial
  IGFBP-2 heparin binding domain-containing peptide sequence
RRKLGVNNPHH

SEQ ID NO: 8689 - protein, 11 aa, Artificial
  IGFBP-2 heparin binding domain-containing peptide sequence
HRKLGVNNPHH

SEQ ID NO: 8690 - protein, 11 aa, Artificial
  IGFBP-2 heparin binding domain-containing peptide sequence
KHRLGVNNPHH

SEQ ID NO: 8691 - protein, 11 aa, Artificial
  IGFBP-2 heparin binding domain-containing peptide sequence
RHRLGVNNPHH

SEQ ID NO: 8692 - protein, 11 aa, Artificial
  IGFBP-2 heparin binding domain-containing peptide sequence
HHRLGVNNPHH

SEQ ID NO: 8693 - protein, 11 aa, Artificial
  IGFBP-2 heparin binding domain-containing peptide sequence
KKRLGVNNPHH

SEQ ID NO: 8694 - protein, 11 aa, Artificial
  IGFBP-2 heparin binding domain-containing peptide sequence
RKRLGVNNPHH

SEQ ID NO: 8695 - protein, 11 aa, Artificial
  IGFBP-2 heparin binding domain-containing peptide sequence
HKRLGVNNPHH

SEQ ID NO: 8696 - protein, 11 aa, Artificial
  IGFBP-2 heparin binding domain-containing peptide sequence
KRRLGVNNPHH

SEQ ID NO: 8697 - protein, 11 aa, Artificial
  IGFBP-2 heparin binding domain-containing peptide sequence
RRRLGVNNPHH

SEQ ID NO: 8698 - protein, 11 aa, Artificial
  IGFBP-2 heparin binding domain-containing peptide sequence
HRRLGVNNPHH

SEQ ID NO: 8699 - protein, 11 aa, Artificial
  IGFBP-2 heparin binding domain-containing peptide sequence
KHHIGVNNPHH

SEQ ID NO: 8700 - protein, 11 aa, Artificial
  IGFBP-2 heparin binding domain-containing peptide sequence
RHHIGVNNPHH

SEQ ID NO: 8701 - protein, 11 aa, Artificial
  IGFBP-2 heparin binding domain-containing peptide sequence
HHHIGVNNPHH

SEQ ID NO: 8702 - protein, 11 aa, Artificial
  IGFBP-2 heparin binding domain-containing peptide sequence
KKHIGVNNPHH

SEQ ID NO: 8703 - protein, 11 aa, Artificial
  IGFBP-2 heparin binding domain-containing peptide sequence
RKHIGVNNPHH

SEQ ID NO: 8704 - protein, 11 aa, Artificial
  IGFBP-2 heparin binding domain-containing peptide sequence
HKHIGVNNPHH

SEQ ID NO: 8705 - protein, 11 aa, Artificial
  IGFBP-2 heparin binding domain-containing peptide sequence
KRHIGVNNPHH

SEQ ID NO: 8706 - protein, 11 aa, Artificial
  IGFBP-2 heparin binding domain-containing peptide sequence
RRHIGVNNPHH

SEQ ID NO: 8707 - protein, 11 aa, Artificial
  IGFBP-2 heparin binding domain-containing peptide sequence
HRHIGVNNPHH

SEQ ID NO: 8708 - protein, 11 aa, Artificial
  IGFBP-2 heparin binding domain-containing peptide sequence
KHKIGVNNPHH

SEQ ID NO: 8709 - protein, 11 aa, Artificial
  IGFBP-2 heparin binding domain-containing peptide sequence
RHKIGVNNPHH

SEQ ID NO: 8710 - protein, 11 aa, Artificial
  IGFBP-2 heparin binding domain-containing peptide sequence
HHKIGVNNPHH

SEQ ID NO: 8711 - protein, 11 aa, Artificial
  IGFBP-2 heparin binding domain-containing peptide sequence
KKKIGVNNPHH

SEQ ID NO: 8712 - protein, 11 aa, Artificial
  IGFBP-2 heparin binding domain-containing peptide sequence
RKKIGVNNPHH

SEQ ID NO: 8713 - protein, 11 aa, Artificial
  IGFBP-2 heparin binding domain-containing peptide sequence
HKKIGVNNPHH

SEQ ID NO: 8714 - protein, 11 aa, Artificial
  IGFBP-2 heparin binding domain-containing peptide sequence
KRKIGVNNPHH

SEQ ID NO: 8715 - protein, 11 aa, Artificial
  IGFBP-2 heparin binding domain-containing peptide sequence
RRKIGVNNPHH

SEQ ID NO: 8716 - protein, 11 aa, Artificial
  IGFBP-2 heparin binding domain-containing peptide sequence
HRKIGVNNPHH

SEQ ID NO: 8717 - protein, 11 aa, Artificial
  IGFBP-2 heparin binding domain-containing peptide sequence
KHRIGVNNPHH

SEQ ID NO: 8718 - protein, 11 aa, Artificial
  IGFBP-2 heparin binding domain-containing peptide sequence
RHRIGVNNPHH

SEQ ID NO: 8719 - protein, 11 aa, Artificial
  IGFBP-2 heparin binding domain-containing peptide sequence
HHRIGVNNPHH

SEQ ID NO: 8720 - protein, 11 aa, Artificial
  IGFBP-2 heparin binding domain-containing peptide sequence
KKRIGVNNPHH

SEQ ID NO: 8721 - protein, 11 aa, Artificial
  IGFBP-2 heparin binding domain-containing peptide sequence
RKRIGVNNPHH

SEQ ID NO: 8722 - protein, 11 aa, Artificial
  IGFBP-2 heparin binding domain-containing peptide sequence
HKRIGVNNPHH

SEQ ID NO: 8723 - protein, 11 aa, Artificial
  IGFBP-2 heparin binding domain-containing peptide sequence
KRRIGVNNPHH

SEQ ID NO: 8724 - protein, 11 aa, Artificial
  IGFBP-2 heparin binding domain-containing peptide sequence
RRRIGVNNPHH

SEQ ID NO: 8725 - protein, 11 aa, Artificial
  IGFBP-2 heparin binding domain-containing peptide sequence
HRRIGVNNPHH

SEQ ID NO: 8726 - protein, 11 aa, Artificial
  IGFBP-2 heparin binding domain-containing peptide sequence
KHHVGVNNPHH

SEQ ID NO: 8727 - protein, 11 aa, Artificial
  IGFBP-2 heparin binding domain-containing peptide sequence
RHHVGVNNPHH

SEQ ID NO: 8728 - protein, 11 aa, Artificial
  IGFBP-2 heparin binding domain-containing peptide sequence
HHHVGVNNPHH

SEQ ID NO: 8729 - protein, 11 aa, Artificial
  IGFBP-2 heparin binding domain-containing peptide sequence
KKHVGVNNPHH

SEQ ID NO: 8730 - protein, 11 aa, Artificial
  IGFBP-2 heparin binding domain-containing peptide sequence
RKHVGVNNPHH

SEQ ID NO: 8731 - protein, 11 aa, Artificial
  IGFBP-2 heparin binding domain-containing peptide sequence
HKHVGVNNPHH

SEQ ID NO: 8732 - protein, 11 aa, Artificial
  IGFBP-2 heparin binding domain-containing peptide sequence
KRHVGVNNPHH

SEQ ID NO: 8733 - protein, 11 aa, Artificial
  IGFBP-2 heparin binding domain-containing peptide sequence
RRHVGVNNPHH

SEQ ID NO: 8734 - protein, 11 aa, Artificial
  IGFBP-2 heparin binding domain-containing peptide sequence
HRHVGVNNPHH

SEQ ID NO: 8735 - protein, 11 aa, Artificial
  IGFBP-2 heparin binding domain-containing peptide sequence
KHKVGVNNPHH

SEQ ID NO: 8736 - protein, 11 aa, Artificial
  IGFBP-2 heparin binding domain-containing peptide sequence
RHKVGVNNPHH

SEQ ID NO: 8737 - protein, 11 aa, Artificial
  IGFBP-2 heparin binding domain-containing peptide sequence
HHKVGVNNPHH

SEQ ID NO: 8738 - protein, 11 aa, Artificial
  IGFBP-2 heparin binding domain-containing peptide sequence
KKKVGVNNPHH

SEQ ID NO: 8739 - protein, 11 aa, Artificial
  IGFBP-2 heparin binding domain-containing peptide sequence
RKKVGVNNPHH

SEQ ID NO: 8740 - protein, 11 aa, Artificial
  IGFBP-2 heparin binding domain-containing peptide sequence
HKKVGVNNPHH

SEQ ID NO: 8741 - protein, 11 aa, Artificial
  IGFBP-2 heparin binding domain-containing peptide sequence
KRKVGVNNPHH

SEQ ID NO: 8742 - protein, 11 aa, Artificial
  IGFBP-2 heparin binding domain-containing peptide sequence
RRKVGVNNPHH

SEQ ID NO: 8743 - protein, 11 aa, Artificial
  IGFBP-2 heparin binding domain-containing peptide sequence
HRKVGVNNPHH

SEQ ID NO: 8744 - protein, 11 aa, Artificial
  IGFBP-2 heparin binding domain-containing peptide sequence
KHRVGVNNPHH

SEQ ID NO: 8745 - protein, 11 aa, Artificial
  IGFBP-2 heparin binding domain-containing peptide sequence
RHRVGVNNPHH

SEQ ID NO: 8746 - protein, 11 aa, Artificial
  IGFBP-2 heparin binding domain-containing peptide sequence
HHRVGVNNPHH

SEQ ID NO: 8747 - protein, 11 aa, Artificial
  IGFBP-2 heparin binding domain-containing peptide sequence
KKRVGVNNPHH

SEQ ID NO: 8748 - protein, 11 aa, Artificial
  IGFBP-2 heparin binding domain-containing peptide sequence
RKRVGVNNPHH

SEQ ID NO: 8749 - protein, 11 aa, Artificial
  IGFBP-2 heparin binding domain-containing peptide sequence
HKRVGVNNPHH

SEQ ID NO: 8750 - protein, 11 aa, Artificial
  IGFBP-2 heparin binding domain-containing peptide sequence
KRRVGVNNPHH

SEQ ID NO: 8751 - protein, 11 aa, Artificial
  IGFBP-2 heparin binding domain-containing peptide sequence
RRRVGVNNPHH

SEQ ID NO: 8752 - protein, 11 aa, Artificial
  IGFBP-2 heparin binding domain-containing peptide sequence
HRRVGVNNPHH

SEQ ID NO: 8753 - protein, 13 aa, Artificial
  IGFBP-2 heparin binding domain-containing peptide sequence
KHLSLEEPKKLRP

SEQ ID NO: 8754 - protein, 13 aa, Artificial
  Synthetic control peptide
AALSLEEPAALAP

SEQ ID NO: 8755 - protein, 18 aa, Artificial
  IGFBP-5 heparin binding domain-containing peptide sequence
RKGFYKRKQCKPSRGKRK

That which is claimed is:

1. A method for enhancing bone formation and inhibiting bone resorption simultaneously in a subject in need thereof, comprising administering to the subject a peptide selected from the group consisting of:

a) a peptide consisting of the amino acid sequence KHHLGLEEPKKLR (SEQ ID NO:1), plus an additional 0, 1, 2 or 3 amino acid residues at the carboxy terminus;

b) a peptide consisting of the amino acid sequence KHHLGLEEPKK (SEQ ID NO:2), plus an additional 0, 1, 2 or 3 amino acid residues at the carboxy terminus;

c) a peptide consisting of the amino acid sequence HLGLEEPKKLR (SEQ ID NO:3), plus an additional 0, 1, 2 or 3 amino acid residues at the carboxy terminus;

d) a peptide consisting of the amino acid sequence KHHLGLEEPKKLR (SEQ ID NO:1), wherein the K or H at positions 1, 2, or 3 is substituted with arginine or lysine, the L at positions 4 or 6 is substituted with I or V, the K at positions 10 or 11 is substituted with H or R, the L at position 12 is substituted with I or V and/or the R at position 13 is substituted with K or H, plus an additional 0, 1, 2 or 3 amino acid residues at the carboxy terminus;

e) a pharmaceutically acceptable salt of any of the peptides of (a) through (d); and f) any combination of (a) through (e) above, in an amount effective to enhance bone formation and inhibit bone resorption simultaneously in said subject.

2. The method of claim 1, wherein the peptide has a polyethylene glycol (PEG) moiety coupled to either terminus thereof.

3. The method of claim 2, wherein the PEG moiety is coupled to a cysteine residue.

4. The method of claim 1, wherein said administration is selected from the group consisting of subcutaneous administration, oral administration, intravenous administration, intraperitoneal administration, intramuscular administration, administration via an implant, administration via a matrix, administration via a gel, and any combination thereof.

5. A method for inducing deposition and maturation of bone in a subject having a compromised bone condition, comprising administering to said subject a peptide selected from the group consisting of:

a) a peptide consisting of the amino acid sequence KHHLGLEEPKKLR (SEQ ID NO:1), plus an additional 0, 1, 2, or 3 amino acid residues at the carboxy terminus;

b) a peptide consisting of the amino acid sequence KHHLGLEEPKK (SEQ ID NO:2), plus an additional 0, 1, 2, or 3 amino acid residues at the carboxy terminus;

c) a peptide consisting of the amino acid sequence HLGLEEPKKLR (SEQ ID NO:3), plus an additional 0, 1, 2, or 3 amino acid residues at the carboxy terminus;

d) a peptide consisting of the amino acid sequence KHHLGLEEPKKLR (SEQ ID NO:1), wherein the K or H at positions 1, 2, or 3 is substituted with arginine or lysine, the L at positions 4 or 6 is substituted with I or V, the K at positions 10 or 11 is substituted with H or R, the L at position 12 is substituted with I or V and/or the R at position 13 is substituted with K or H, plus an additional 0, 1, 2, or 3 amino acid residues at the carboxy terminus;

e) a pharmaceutically acceptable salt of any of the peptides (a) through (d); and f) any combination of (a) through (e) above, in an amount effective to induce deposition and maturation of bone in said subject.

6. The method of claim 5, wherein the peptide has a polyethylene glycol (PEG) moiety coupled to either terminus thereof.

7. The method of claim 6, wherein the PEG moiety is coupled to a cysteine residue.

8. The method of claim 5, wherein said compromised bone condition is at a targeted site of said subject.

9. The method of claim 8, wherein the targeted site is selected from the group consisting of an intervertebral space, a facet joint, a site of a bone fracture, a bone of the mouth, a bone of the chin, a bone of the jaw, an implant site and any combination thereof.

10. The method of claim 5, wherein the condition is selected from the group consisting of a broken bone, a bone defect, a bone transplant, a bone graft, bone cancer, a joint replacement, a joint repair, a fusion, a facet repair, a bone degeneration, a dental implant, a dental repair, a bone marrow deficit and any combination thereof.

11. The method of claim 10, wherein the bone defect is a gap, deformation or a nonunion fracture in a bone.

12. The method of claim 10, wherein the bone defect is due to dwarfism.

13. The method of claim 10, wherein the bone degeneration is due to osteopenia or osteoporosis.

14. The method of claim 10, wherein the joint replacement is of a joint selected from the group consisting of a vertebral joint, a knee joint, a hip joint, a tarsal joint, a phalangeal joint, an elbow joint, a shoulder joint, an ankle joint, a wrist joint, a sacroiliac joint and any combination thereof.

15. The method of claim 10, wherein the joint repair is of a joint selected from the group consisting of a vertebral joint, a knee joint, a hip joint, a tarsal joint, a phalangeal joint, an elbow joint, a shoulder joint, an ankle joint, a wrist joint, a sacroiliac joint and any combination thereof.

16. The method of claim 10, further comprising administering a bone resorption inhibitor to said subject in an effective amount.

17. A method for enhancing bone formation and inhibiting bone resorption simultaneously in a subject in need thereof, comprising administering to the subject:

a) a peptide consisting of a fragment of insulin-like growth factor binding protein-2 (IGFBP-2), said fragment being between 11 and 16 amino acid residues in length and comprising the amino acid sequence:

i) KHHLGLEEPKKLR (SEQ ID NO: 1);

ii) KHHLGLEEPKK (SEQ ID NO: 2);

iii) HLGLEEPKKLR (SEQ ID NO: 3); or iv) KHHLGLEEPKKLR (SEQ ID NO: 1), wherein the K or H at positions 1, 2, or 3 is substituted with arginine or lysine, the L at positions 4 or 6 is substituted with I or V, the K at positions 10 or 11 is substituted with H or R, the L at position 12 is substituted with I or V and/or the R at position 13 is substituted with K or H; or b) a pharmaceutically acceptable salt of a);

in an amount effective to enhance bone formation and inhibit bone resorption simultaneously in said subject.

18. The method of claim 17, wherein the peptide has a polyethylene glycol (PEG) moiety coupled to the N- or to the C-terminal thereof.

19. The method of claim 18, wherein the PEG moiety is coupled to a cysteine residue.

* * * * *